United States Patent 11,446,398 (REGULATED BIOCIRCUIT SYSTEMS) - sequence listing, part 66

SEQ ID NO: 164129 - DNA, 12919 bp, Homo sapiens
  Payload ID: 12315
  Gene Symbol: PCNX
  Gene Name: pecanex homolog (Drosophila)
  Uniprot ID: Q96RV3
  ENST ID: ENST00000304743
  CDS Start-End: 447-7472
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctgcccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggaaccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatgggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttgc

SEQ ID NO: 164130 - DNA, 6988 bp, Homo sapiens
  Payload ID: 12315
  Gene Symbol: PCNX
  Gene Name: pecanex homolog (Drosophila)
  Uniprot ID: Q96RV3
  ENST ID: ENST00000439984
  CDS Start-End: 113-6805
ctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctgcccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggaggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctc

SEQ ID NO: 164131 - DNA, 384 bp, Homo sapiens
  Payload ID: 12315
  Gene Symbol: PCNX
  Gene Name: pecanex homolog (Drosophila)
  ENST ID: ENST00000555780
  CDS Start-End: 1-288
aaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccg

SEQ ID NO: 164132 - DNA, 4204 bp, Homo sapiens
  Payload ID: 12315
  Gene Symbol: PCNX
  Gene Name: pecanex homolog (Drosophila)
  ENST ID: ENST00000554691
  CDS Start-End: 1-3986
cagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagtt

SEQ ID NO: 164133 - DNA, 595 bp, Homo sapiens
  Payload ID: 12315
  Gene Symbol: PCNX
  Gene Name: pecanex homolog (Drosophila)
  ENST ID: ENST00000556849
  CDS Start-End: 1-595
ctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataaagttttgcccttgtcatccaggctggagtgcaatgacacaatctcgactcactgcaacctccgcctcccggagtgcaatggcgccatcttgattcactgcaacctccgcctcccaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtc

SEQ ID NO: 164134 - DNA, 7518 bp, Homo sapiens
  Payload ID: 12316
  Gene Symbol: PCNXL2
  Gene Name: pecanex-like 2 (Drosophila)
  Uniprot ID: A6NKB5
  ENST ID: ENST00000258229
  CDS Start-End: 236-6649
tggcgctcacctgcccggccgcagcagccggctccggcgccgcggttcgcgggtccgggcggaagagcagctccagcttcaaacgtggggtggaaggaggcggcgggggcgacggcggcggcgacggcgggggcgcggcccgcgggcccgggtgttagacctgagggagcctggagatccggccggggcgcgcagggtgcagcggggcgctcaccagccccggggcgcagccggcatggtgtcccaggtgctgcagctgctccggcagggcgtgtgggccgcgctcaccgggggctggtaccacgacccggagcagagcaagttcaccaacagctgccacctctacctgtggctgttcctcctgctgctgcccctggccctgcacctggcttttcctccaaatgcgatcattgtatttttctactgcagtgcagtgactatattcttcacaataatcaaactggtcagttatcgcctacacctcatgtttgacaaaggagaagtaattcagcaaaagccctccagaaaggaagaaaagccaaataaagacaaggaggccaaaggtgaacacataactaatcacagaaatccaagcaataataggcagattcacaatggcaaaaaggaagaggccagtcgaaacctctccacgcctcccctccgctgcagctccagagggcaaagcataacctctcatcactcttctgggccattggagttgtcagcacaggaaactgtagaagatctcaaaggtgtcattctattagaagaccatcccatagcaccagtgtcatctacctcacctggtatcaaagtggaaagcttacctgcgtctcaagcacacatgctggaaaccacgaccaagtcagtaatacctgtaaaaccagttgccacagaaactctcatcaatggtaaaggaaaggaaagaggaggcaaggggcagcctcctttgcgccacagatccgagggtggcttagtggataagggacccttgaagaagttgccccacctgtctttgtctcagtatgacttactagaaacagacgtttctttccagccgtgggggagtgagaattcagtcctgattccagaacctgtcagttgtccccggggctccataagggaacgggtacaaagcaagtcacctcaggacagcctgagcagcagctgccctcaatgtgacaccatcgtggccaagcctgtggaggagccagcagacacatcctgtcaggtagatacctcctgccagggggacctgcccttgcaccaggaagtggactcctcagatagtgaggtagctgttactctcatcgatacttctcaacccggagacccactgagtctacatgagcccataaaaattgttatcacgatgagcagtaccccaaactccatgacagatttggaaagctccctccacctgagggtggttggcacagagaagaccagtgtaaagtctgacgctgagcccactaacccaggggcggccggttctccaaatgccgagcagatctcaattcctgtaatcaccctggacctgcctgagggtgggggaggaggtgttccctgtcccgaaggcaatggaagtgaaaggactccagagagactgaagacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccagtgaaattctgggagaaaaactacaatacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagtta

SEQ ID NO: 164135 - DNA, 5348 bp, Homo sapiens
  Payload ID: 12316
  Gene Symbol: PCNXL2
  Gene Name: pecanex-like 2 (Drosophila)
  Uniprot ID: A6NKB5
  ENST ID: ENST00000344698
  CDS Start-End: 1197-3530
cgaatatatcagatttaaccatatgaaattgccattttgtaggtgataataaacagttgactatcgtcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagagctttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccaggttggagtgcagtggtgcaatctcggctcactgcgacctcggcctcctggattcaagttcagcctcccaagtagctgagattataggagtgtgccaccacacatggctaatctttttgtatttttagtagagatggagtttcacactgtttgccagactggtaccaagctcctgacttcaaatgatctgcctgcctcagcctccctaagtgttgggattacaggcatgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttaggtatttaaatactagacaaggagagttctaaggacttcacccaaataagctgttacttgtccagaatcccaaaccagctgagatgaaatgaatacttgagcttcttcagtgagaaaaaagtaaataaatacccagcagtgctcctatgtgacctggtagacagggaaaatcgatggtgtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgttctactggggtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttg

SEQ ID NO: 164136 - DNA, 1982 bp, Homo sapiens
  Payload ID: 12316
  Gene Symbol: PCNXL2
  Gene Name: pecanex-like 2 (Drosophila)
  ENST ID: ENST00000430153
  CDS Start-End: 747-1982
gccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaag

SEQ ID NO: 164137 - DNA, 561 bp, Homo sapiens
  Payload ID: 12316
  Gene Symbol: PCNXL2
  Gene Name: pecanex-like 2 (Drosophila)
  ENST ID: ENST00000490102
  CDS Start-End: 1-328
gttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaaggacggcacccacacacaaagaggatgatttcccttaactcaaaccatgcaagttactgcagttcatctcatgggaggggctgaaatacacgctagtaactcctctgcccttcagccttcaaactcggggacctgcttcacaagttacagttcgtcctgacatatgtggctccttggcagatggcttggggttcttcgtttcacgtgtttgctcagctctttgccattcctcattctgccatgcttttctttcagacgatt

SEQ ID NO: 164138 - DNA, 803 bp, Homo sapiens
  Payload ID: 12316
  Gene Symbol: PCNXL2
  Gene Name: pecanex-like 2 (Drosophila)
  ENST ID: ENST00000484347
  CDS Start-End: 1-537
gagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcgtatcctttctgcttctattttcaccctccagctgagattcacattttacggaagcaagcttttcattgacccctggcaataaaaagattttaaagtctataagattacattttaatggggacatgaagaggcactttggatccctttaggccacttagccttaaaagatatttctttattttgaactcttcctgcttcttaatgcatattcaggagttacttttattttttctggtccttccatttcccatgcccagatctgcattaaggtaccctgtcttttaaactgcttaaatgattgggttgccttgtgcaaaatagtgcaaataaatttgctgttattaagca

SEQ ID NO: 164139 - DNA, 3392 bp, Homo sapiens
  Payload ID: 12316
  Gene Symbol: PCNXL2
  Gene Name: pecanex-like 2 (Drosophila)
  ENST ID: ENST00000462233
  CDS Start-End: 1-1471
tttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccagtgaaattctgggagaaaaactacaatacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttg

SEQ ID NO: 164140 - DNA, 654 bp, Homo sapiens
  Payload ID: 12316
  Gene Symbol: PCNXL2
  Gene Name: pecanex-like 2 (Drosophila)
  ENST ID: ENST00000486012
  CDS Start-End: 1-142
tgaccctctccccaagaagatgaaagattcagtgacggatgtcttaaaatgggatctcatcgtctgcgcagtggttgctgtcctctcatttgcagtcagcgccagcactgtattcctgtcattgcgaatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcgtatcctttctgcttctattttcaccctccagctgagattcacattttacggaagcaagcttttcattgacccctggcaataaaaagattttaaagtc

SEQ ID NO: 164141 - DNA, 545 bp, Homo sapiens
  Payload ID: 12316
  Gene Symbol: PCNXL2
  Gene Name: pecanex-like 2 (Drosophila)
  ENST ID: ENST00000518351
  CDS Start-End: 1-545
aaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgct

SEQ ID NO: 164142 - DNA, 307 bp, Homo sapiens
  Payload ID: 12316
  Gene Symbol: PCNXL2
  Gene Name: pecanex-like 2 (Drosophila)
  ENST ID: ENST00000517808
  CDS Start-End: 1-137
atatgtgggtgctcctcttctgcctcgtcatggccagctgccagtactccctgctaaagagtgttcagcctgaccccgcctcaccaatacacgggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctggg

SEQ ID NO: 164143 - DNA, 2183 bp, Homo sapiens
  Payload ID: 12316
  Gene Symbol: PCNXL2
  Gene Name: pecanex-like 2 (Drosophila)
  ENST ID: ENST00000475463
  CDS Start-End: 1-655
gccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaaggtgtttctgggctacgtgaggcaaaaataaaaacagagaaactcaccacagtgtttttccttggatcccatgatgcccagatgctctactttttccttttacctttcagaaggtgtttttataacatgtaaaatccagggttttcgttgtaccaagtagaggaataaggaaaaatacaccaactccatatttccggaagaa

SEQ ID NO: 164144 - DNA, 1465 bp, Homo sapiens
  Payload ID: 12316
  Gene Symbol: PCNXL2
  Gene Name: pecanex-like 2 (Drosophila)
  ENST ID: ENST00000488780
  CDS Start-End: 1-1275
atgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaaggcaagtgaattagctattttcttcattttaacattttaaagggggctgttcttatcaaatgttttaagagtttaaaacttattctttataaaaaaaattatgggaggatatgaaattgaattatacatgtatgttaaactcttgctaccatttggggaaaactgcccatggaatgtaagtatgccatgttatttgctaaaaatcactaattaaaatgaattagccatta

SEQ ID NO: 164145 - DNA, 7105 bp, Homo sapiens
  Payload ID: 12317
  Gene Symbol: PCNXL3
  Gene Name: pecanex-like 3 (Drosophila)
  Uniprot ID: Q9H6A9
  ENST ID: ENST00000355703
  CDS Start-End: 540-6644
ggcgcatgcgccactgcaggctggcggttcgcggctccttcttccggcctcctccttaggccggcaccagcagaagccgggcgagcgcggagccccaagcaagtgacctgcgaccccgaaagtggaccccagatcctggggttctccctggtccggagactagggagctgtcgcctgcaccccgggagcacccaccccacgaccacctctggatgccgccgacgggtacccggcccgtgccccgcgcctgcctgccggctcggcccctcggagcaattctgggccaggagtggggacccggaccccgcccctgatgcagccccacccccgcgtccgggccttgcaccactgactgtcccggccggccccgccccctgctcgcaccctcgcgcggccgagcccccctcccccgctgggggaggccatggcgtgagcgtgaggccgggccccggggccctcaggcgccagacggggcatgggccgggggccgcccccatgagggtcccgggagggggggcgcgggcagcagcggcggggccatggggtcgcaggtgttgcagatcctgcgccagggggtgtgggcctcgctcaccggcggttggttcttcgacccgcaccagagcaccttctccaactgcttccacctctatgtctggatcttcctgctcatctttcccttcttactgtacatggtcctgcctcccagcttgatggtggccggcgtgtactgcctcgtggtggctgtcatctttgctactatcaagactgtcaattatcggcttcatgccatgtttgaccagggcgagatcgtggagaagcgcagctctaccatgggggagctggaggaagagcctgcccagggggacagcaatccacccagggaccccggagtggagatgacagtgttccggaaagtcagttccacacccccggtgcgctgcagctcccagcactctgtgtttggcttcaaccaggtctcggagctgctgccccgaatggaggactctgggccccttagagacatcaaggagctggtgcgggagcagggcagcaacaatgtgatcgtgacttctgccgaccgagagatgctgaagctcagctcgcaggagaaactgattggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccagcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggagcggccgaggagactggcaggcgggaccgctcaagcagtgtgaggcggacccaggccattcggagacgccacaatgcaggcagcaaccccacccctccagcctctgtcatgggctcgccgcccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgctgtgcactatttctacgatgagagcggtgtgcggcgttcctacacctttggcctggctggaggcggctacgagaaccctgtagggcagcaaggggagcagacagctaatggagcctgggaccgacactcgcattcctccagcttccactcggctgatgtccctgaggctacaggcggcctgaacctgctgcagccgaggcctgtggttctgcagggcatgcaggtgcgccgggtgcccctggagatcccggaggagcagacactgatggaagaagcgccaccccgggcccagcatagttacaagtactggcttctccctggccgctggacctctgtgcgctatgagcggcttgccctgctggctctgctggaccggacgcggggagtgctggagaacatcttcggcgtgggcctgagcagccttgtggccttcctgggctacctgctgctgctcaagggcttcttcactgacatctgggtcttccagttctgcctggtcatcgcctcctgccagtactccttgctgaagagcgtgcagcctgatgcggcgtcccccatgcacggccacaactgggtgatcgcgtacagccgtcctgtctacttctgcatctgctgtctgctcatctggctgctggacgccctgggctcagctcagcccttcccacctgtctccctctacggcctcacgctcttctctgcctccttcttcttctgtgcccgagacgtggccactgtgttcaccctgtgcttccccttcgtcttcctcctgggcctcctgccccaggtcaacacctgcctcatgtacctgctggagcaaatagatatgcacggcttcgggggcacagctgccaccagcccgctcacggcagtcttcagcctctcccgcagcctgctggctgctgccctgctctacggtttctgccttggggccatcaagactccgtggccagagcagcacgtccctgtcctcttctcagtcttctgtggcctcctggtggcactgtcctaccacctgagccggcagagcagcgaccccaccgtgctctggtctctgatccggagcaagctgttccctgagctggaggagcgcagcttggagacagcccgggccgagcccccggaccccttgccggacaagatgcgccagtcggtgcgtgaggtcttgcactccgacctggtgatgtgtgtggtgatcgccgtgctcaccttcgccatcagcgccagcaccgtctttattgccctgaagtcggtgctgggtttcgtgttgtacgcactggctggggccgtgggcttcttcacacattacctgctgccacaactccgcaaacagctgccctggttctgcctgtcacagcccgtgctgaagccgctggagtacagccagtatgaagtgcgcggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctactgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaagctgtgggacttgctgtacaagctgcgtttcgtgctgacctacatcgcgccctggcagatcacctggggctcggctttccacgcttttgcccagccgtttgccgtgccacactcggccatgctgttcgtccaggccctgctctcggggctcttctccacgcctctcaacccactgctaggcagtgccgtcttcatcatgtcctacgctcggcccctcaagttctgggagcgcgactacaacactaaacgtgtggatcattccaacacccgcctggtcacacagctggacaggaaccctggcgctgatgacaacaacctcaactccatcttctatgagcacttgacacgttcgctgcagcacacactgtgtggggacctggtgctgggccgctggggcaactatggccctggtgactgcttcgtcctggcctctgactacctcaacgccctggtgcacctcatcgaggttggcaatggcctcgtcaccttccagctgcgtggccttgagttccggggcacttactgccagcagcgcgaggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccagcccgtggaccaggattggaactccccgctggtcacgctgtgttttggcctgtgtgtgctgggccgccgggccctggggacagcctctcacagcatgtctgcaagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttg

SEQ ID NO: 164146 - DNA, 17339 bp, Homo sapiens
  Payload ID: 12318
  Gene Symbol: PCNXL4
  Gene Name: pecanex-like 4 (Drosophila)
  ENST ID: ENST00000317623
  CDS Start-End: 523-3339
aacgacgctcttgcgtaaaggcccggcccaagggaacgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggagcgcccagcccgagtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaatatccttctaatatatgtgaaaggagcggggttcatcccattcatcatgtgaatattcacaggaagagcaatgttagggtaatctgcatatgactactaaagcatatatctgactcattatgtatttctttcaactgaatttactgcttctgaaaaatgatttacccaacaggactaccagttactagtgtcttaaggtatatgaactaaagtcagaaggagatggaagaaaatttttataatacgatctgaattttattttcattctcttcttgcttaggaacgttttacagatacatgtaagggggattaataatgaatccacatcagttgagagatcagtttcctctaattcttacttaatttccaatgaaatcagtaggagccccctagatttataataatgtattctccttagaaatcattcaaattatatgaaatgtaccagttaagttgttattagtattccatttatttagtatgtggacgagttcactctaacaatgttaaaggataaactttttggaccaattttcagttaatgaattcaagagatttgtatgttattctttttttggaggtaatatagtacagttactaagataggattttgtattactctgagtttacatctcagacttatgatttaatttacatgattgagatttgctagctgtacacctttatatctttgtcatgtagaaatattttctcatgtcgttaaaagtacttgtaattatcagcttttttttttttccgagatggaatctcgctctgtcacccaggctggggtgcagtggcacgatctcagctcactgcaacctccgccttctgggttcaagcgattctcctggctcagcctcctgagtagctgggattaaaggcgcatgccaccacgccggctaatttttgtatttttagtagagacagagtttcaccatgttggccaggctggtctcgaactcttgacctcatgctccgcccgcctcagcctcccaaagtgctgggattacaggcgtgagccaccgtgcccagccataattatcacttttaatgacagcataaaattccattgatagatattatttattggactactgtcccccaaataatgtgaattttaagttgtttagagattttcactgtgataataatgtcaagctatgccttcgcttaaccttgcatcctcctcaaagtgctcccatatctccatttcattcatagccaggttttctctttcatttacttgtcaaatcattccaatctggatcccatctccatgactctcccaaattaaaaaaaaaaaaagtttttattaaggtcactattgacctttttattgtcaaaccagctagtagtaattgacacatttgaccattccttgaagcagcttttgtgttttcttttgaactttcctgacactacattatctttgttttcttcttatcttcctagcaactcctcaaacatctttgctgcctctcctcttctacctgacctctaaattttagaatttctcaacaattgattctaggcccccctttgtgtttctgcaatcaccatagataatctcatctacttcaagacttgaaatatcatcaataaattgatgatgatcaaatatatgtacctaacccaacctctcttcttacactgaacctatatatatcacttatttggtatcttcacttggtatattaaaaactgactgttagattttgaagggaaggtgagagttaaagaaagacacacagagggcagcttgacagcaaatgcagactttatgtctagcataaaacctacagaagtgggggaccagcttaatgccagagcccaccgctgcttacaggctgggcgtacttataggcatgggtgagaggggtctgggcagtatggcttgctgctcggcaggatattgataagatgctcccatgatgaggtggttctggcccttgttgtggtgggatgtcatcatagtattccttggaactttgcccagcaagatatgatagggatatttcttaggttgggcctttttccgccttgtggtcaggtggttaggcagcatgtttctcactgcccgaacccctgtgaaatgttttactttgatcaaggtctgcaaaatagcggggagcttacaaaatggtgcagtttggactaacactaacgttactgaattttccctaaaacctacttttctacttctaacttttagtggtgcattcataccaactatttcagagaactagcaatgccaggcaaaatagtattttaaaatctgcttaaaggcattagagaaccaaaagacagtgaagaataacatcactaagatctaagacagaatgaaacttagagacctgagctcagcatttgggctgcttttcttataggagacatgccaattcaggataaggtggttgagagtctgagacgctaagtaacacttataacagccttgctgctgagttagagggacaaaaactggagaccaagactctccaaggaagtaggggaggggaaaggaatcctagttaactgaccatacattgggttgtgaccccaaggaccatatccaaattgtaagggtgaagaaaaaccagatgcagttaggatcttctcacttcccaaaactggattcaggtgaccctttgctgcagccgctacccagagcaaatgtaaatcctctctggactgatcttttgagttatttttataacttttcatgtttagtgttggaaagttatttaaggtatctgaggaaacaagacaacatgatgaaaatccgaaagaagcgacagatgatgggacagagccacaggggacccagataatgagctatacaacacagggtctaaaattactatgtttagtgtgtttaaagatctaaaacacaagattgagaatttcagcagaaaatcagaaactatatagaagaatcaatcaacaagtccccaacttaaaagtacattaatcaagtttaagaattcagtgaataggccgggcgcggtggctcacgcctgtaatcccagcactttgggaggctgaggcgggtggatcatgaggtcaggagatcgagaccatcctggctaacacaatgaaaccccatctgtagtaaaaataaaaaaaaaaataaccgggtgtggtggtgggtgcctgtagtcccagctactcaggaggctgaggcaggagaatcacttgaacccgggaggcagaggtttcagtgagccaagatcatgccactgcactccagcctgggcgacagagcgagactccatctcaaaaagaaaaaaaaaaaaaaaggattcagtgaatagatttgatagaaagtgcatacagtgaagtaagaattagtgaactagaagttatgtcagaagtaaataccagatgtgaaaaactaagagacaaaagaatagaaaatatagtagagagtataagagacatagagttaacttgagaagatctaacatacacgtaactggatttccaggagaagagagaatatggcagaagcaacctgtgaggagataatgactgagaattctccaagtttttaagacatgaagacctgcaagatcaaagcatgataaataaaaacaaaattacaacttagcacatcctaagaaaaaataaaacacaaaaagaaaatcattaaaggagccagacaatgataaaagacattacttttaaaggaggcacaattttattaaactgacagctaacttctcaacagaaaatatgggaagcagaaatcaatggcatgatattttcaggttactgaaagaaaatatctgcaattttagaattcaatacccagcctttccccaaaaacaattcttaagaatgaaggcaaagacactttcaaacgcaacaaatttaatagcagattgtcattaaaggtgatagtaaagggtattcttcagacagaaggaaaaagatcccagaaaaaggttagagataaaggtaggaatgaacagtaatttaaaaatatatatatacagtttaagtgaatattaactatataaaatagtcttcgaggttaaaataaataatgttaaaatgtgacaataatatacaaatttggtgcaggaattctaaggtcagaattatcagaaagaagattaaagtataaataagactgctgtgtcatctatagggtaaccactaaaagaacagcaaaaagcaaaataaaacaatcgtagaactacaaagctaatacagggctaaagtggaataataaggcaaaaaggtagagaaaatatagaacaaataggacaaatagaaatcaaacagtagattaggaggtttaaatatcagttacaacattcatatgaatagacagtgtaccaattaaatgcaaagatcatcaaagtgaaaagaaagaaaacccacaaagtacctttatgcaagagatgtcttaagtataggaatacaaaggtttgaagtaaacaagaatggaaaaattataatatgaaatacaaaaaacaaaaacgatagggcaggggactatggtggctattgcaacattattcaatgtagaccttaaggtgaaaagtattacaaagagagacaatttgtaatgataaaagatttgattcaccagaaagtttcaacaggtctaatattttaatgatttaacaatatagcctcaaatatataagcagaaatgaacagaactaaaatgagaaaagacaagtctgcattcccagattttaatatactcagtaacagaacagcagccatgcaaaaatacgtaaatatgtaaagattggaataatactttaaaacttaacctaattggcatatatgaaacagaatacccaacaactgcaaaatacacattattttcaaatgcagatagaatatttatcaaaactgaccatattccaagtcataggaatggaatatattctttggccatgtatcattcacttagaaatcaataataatttcaaaaatagaaaaattctattaagttcataaattaagaaatacacttttaaataactcatggatcagacaataaattacaatgaaaattagaatatatttgaactgagtagtgaaagtgctacatgtcaaaacttatggtagacgcctaaagccatgcttagaaggaaatttatagtcttaaacgcacattaaaaaaaaaagattgaaaatgaacctagtagttaaaatattctaagaatagcaaattaaacctgaagaaaataaaggaaataataaagaacaagaattaatggagtagaaaatgaagataaagtggatcaactaagccaaaagttgattctttgaaaagataattgataagtgtctggtagactgaaaaaggaagaaacacaaacaaccaatatcaggaatgaaaggatattacaaatcctagagtcatctgacaaaatatgtgcacaacttcatgccaattagttggaaattttagatgaagtgaataaattctttaaactatggaagagccaaaattgacaaatgaaaaaatagaaaattcgagtagttccctatctgctaaagaagtggaacctatagttactttatttgcttttccatagtgaaacaacaagcctagatggattgattcgtcaatggaaagacaatcttaaattcttacaaagagcagtagaaatgcaggaaccctccccaactcattttatgatgccagaaaacctagataccaaaacctggcaaaaactttatgagaaagggacctatttcattccccccaacatcaatgcaaaaatcccaaacaaaatactagcaaactaaactacacacatacacacacacacacacacccctacacacacagaataatcacaatcaagttgggtttcttcctgaaaaagtgaggttggtgtgatagttgcaaatcaatcaatatgattcaacacattaacagaatgaaaggagaaaaataatatttcagtagatccagaaaaagtatttgataaaccagtatccactcataaaaagtttgctttttaatattcatctttatttttcttatcttgagtatgcacataagatgttcagagtcagagatagatttcttattactcagggtaaacaagtgcacctgcccacctttgcactcgtccatatcccccagagcaacctgataagaaactcatgggattttggctatgtaagtggccaaatactgcataggcaagggacagggaaaattaattttccctacttataaagatgaaagaggcagccatcctcttcccttcctgaaagagtctgcttttactctattcttgtggtagacaaagtctctccaaaagccagatagccaaccccatgtgtctccaagagctgtctcctacatcccagggaatacctaggaagatagcatattagaaatgaggaaaggtctcagcacaataacctaagttcccaccacaagaaacaagaaaaagaatagcaaaataagcccaaagcaggcaaaagaaaggaaataaccaaaagcagaaatcaatgaaactgcaaatagaaaaatacataaacaaaaaactggttcttcaaaaaacaatcaagaaaatccataaacctgtagaaagactgacaaaaagaaaaaacacaaatcattattatcaagaatgaaatgaagagtatcactataaatcaggcagtcattaaaaagataatgaggaaatactgtaactttcggcttatacacatgacaacttagaagaaataatctgattcttgaaaaccacaaactattaaaactcaaccaagatgaaataatctgaatatcctataaccattaaagaattaaattcataatttaaaatctcctgataaaagaaatctccagacccagatgccctggcttctttgaggttcttccatgttgttttatgtatcaatcattcattattttttatcgctgagtagtgctgcatggtatagaatataacagtttgtttataccattcacctgttgatggacatttgttggttccagttttgggctattatgtaaagctgctatgagcattcatttacaagtctttatgtggacataagctttcatttctcttgggcaaatacctaggactgggatggctaaatcatatgataagtgtatatttaaatttttaaggaactgctaaaagtctttttcaagttaattgtaccttttgacattcccgccagcagtttatgtgtacaaaatgtataattacatttatgtaaaactataaaatgcaaactaatctataataatgcaagcacatcattggttgcctggaatggggtgggcgaggggaaatgattacaaaagggcaaagggaaacttctggggctgatatatgtgtttactctcttgattgtggttatggttcacaagtgtagccatatggcaaaacttaacaaattgtacactttaaatatatgcagtttatcatacatcaattatacctcagtaaaggtgtcagaaataacaggatatttatatttaaatctacctttgaattaccgattgtgactgaggtctcatgtggcttactggtgaatccagtagttgaggaaacgaaagccgtcacttctgctaactcttttaccaactcacctgctgtcaccttacacaaccccaactgtgtttcagctttggagtaatgaacacaccattttcttcctacttaaaagtccactcaggataatgattaagaaatacattgatgccgagtaataaatactttaaaaaaagttaaatgtgaacatttggctttcacagctcttgactgtctttggcgaaccttgacataaagctgccttttccatcttgggctgctgacaaaaaagcctaagaaagaaagagggtgtgtacagaaaattacatgccatagaaaaataccatacacaggccgggagcggtggcactttgggaggccagggcgggtggatcatttgaggtcaggagtttgagaccagcctggccaacatggtgaaacccccgtctctactaaaaatacaaaacttagccgggcatggtggtgcacacctgtagtcccagctacttgggaggttgaggcaggaggatcgcttgaacccaggaggcagagattgcggtgaactgagatagtgccactgtactctagcctgggcgacacagtaagactccatctccaaaagaaagaaagaaagaaagaaaaaaatgccatacagatgaatctttaaagattttaatttatatatacctcttctaccattcattggctggagtagttgaacagacatcagcaggcacaatgctaggcaggcactggagattcagtgatgaataaaacaaaactgacctggaacctggcctcctgaagcttctcttcatctgtctaaattcctttctttcaaggcccagtgcaagtgacaccttcatcaggaagggcttccacatgattctatctgcaaatctcccttttctgaactattatgcttatagtctgtaccaggccacatgacatatgttattttgtggcattctagaattattccaatcttttcattcttataattggtgtgttgtattcaataaataatgttgttattccagttttcatcactggtcacgcaagagtcctctctttattatattttatccccatagttcaccccgtttcctccccatcctaagtaactattaccatacctaaatatatatctaattaggttgtatgttttcttgcaaaatgagcactatcttctgtgcacatatatttgtgtatgtgaacagtattgtgttagcgttgcttctttatttcttcacttatgactatgcctctagtacatatccatgttgttatgtatgcatttattccattgcttctacccgctatacctcatcgtgtacctctaccacatgtcatcttcccccttttccaaggacagccacttgggtggcttccaacttgcccaacaactattctacagttattttatgtatgttactttggctccagctcaattgtgaactgcttgtagataaggaccatgtttttctttacctgttactcctgctgatttcctattagtgcctgtgcatgttttctgctgtaaggtgttaaatgttaaagtaaaattaataatagtagaagtaaggagttgccagtggaatcttcctgagctgaatctaatcatggctttaccccttactagctttgtgaccttgaccttggaaaagtaaaaccttgttggtctttcttcatctatcaaggtaggtaataccatctatcttagtgggctgttatgaggaatgagttaattaactaatactaagcactccagtacagtagaagacatacaacaggtgtttaatgaataataggtgcaatgaatcctacctgctgcttcaaattacagccatctgtacctgtcaacttttctaagagtataagcatcttggaggtaaggtcatttcaaatacttctttatatctggtcattacccagcactctgctttgtgtgaaatattctatacatttatgttgctatggtttggatgtttttgtcccctccaaaattcatgtcgaaacttaatccccaaagcaacagtattaaaggatgtggcctttaagaggtgactgagtaatgaatgagattaaatgctcttttgaaagcattttgctcctctttcccttctgtcccttccaccatgtgaggacatacattcctccactgtggaggatgcagcaatgaggtgccatcttggaagcagagatcagccttcaccagacactaattctgctggtgcattggtcttggaattcccagcctcaagagccaggaaaaacagatttctgttgtttataaattaccaaatctgtggtattttgttatagcagcacaaatggactaagacaaatctgttaacttagattttaagcatatgtgctaaagtattttaaaaggttattttatccaagaatatagtatgagttaataccttttttgcaagattcatggcaatcttttattatttattttttatttcattccatgttggaagcaaagtcatatctattaaaaagtaaaatcacaaattagtctttgattattcagaagcataagaagattgctgttttcatgttttccatttctccctccagtggcttgaaaagtacaggtgctcttttcagtcatgttttgtcttaaagattttaaaataagaagagtctgcatcctgtaaaagagggacagaaacatggatcagtacctactcctatttactccagtttttaacatttaagtccttctgttttgaggagctgtatcattatgattcactattaagaatctttacaaaagttcagaaactgcttaaattagaatttaaaaatcatagccaaaattctagatgtacacaaaagtacttctaatgagtttagcatcatctctggtttagaggaggtataaatagcattggactgcaatgctaaattctctataatgacttttctggatcagcatatcatacctacactgacttgccctaataaataaaaacaatgagtcagattatgtagaattgagatatatggaagataactctttaaaattatttgtggccaggcaggcactgtggctcatgcctgtaatcccagcactttgggaggccgaggtgggcagatcacctgaggtcaggagttagagaccagcctggcaaaaccccatctctactaaaaatacaaaaattagctgggtgtggtggtgtgcacctgtaatcccagctacccgggaggctgaggcaagagaattgcttgaatccaggaggcggaggttgcagtgagctgagactgcgccattgcactccagcctggccaacaagagggaaactctgtctcaaaaaaaataaaaagaaaaaaaaattatttgtgaactttttgtatattgcttaaggaataaaacaaggcaacctgataatccccaagatgtgatgtttcttttcagaagatatgcatttaccactttcaaaactttgcactaagaaagacaaaataataataatgataatacaaaattcagtgtagccactgttcttgatccctaaaaataataaagattcataaaaacaaagttccagacatacagactaaagaagcaaattctagttaacaagtactattagcttgaaataagctatgctagcattttcttaacttagacgcttatcaataagaaaatttatatatatacatatatataaaatataaaatagtgggagagaggaagagtacagactataaagaatgaggtattatgtcctaaaaattgctttgagaaatgacagaatgcccagcttataataaagagtgacaaagtagtaagactatataataagcaatatttcaaagatggtggtaggaagaaaaaggctgtcatttttttagaaaaacctagatgtaaaaaaaatgcgagatttgctaaatgatgtttatattttacagttagatattctctaaacaaaacaaaatatccttcatatggacatttctggaagtactactacagtgggactgaaattctctagtccctggtccctctttcccctttgaaaaaaaaatcacttctataatatattctttctctgccctattatttaaattgagaatgtgaaccagtacagacattatggaaaatacggaaattcctcaaaaaattaaaaatagaattaccatctgatccagcaattccacttaagggtataaatctaaaggaagtgaaatcagtaccttgaagtgatacctacactcccatgttcattttagcattattcataatagccaagatatggaaacaacctaagtgtccattagtgaatgaatggataaagaaaatgtgtgtgtgtgtctgtgtgtgtatatatatatatggaatattattccacaatggaatatttttcagccataaaacaatggaactcctggcatttgtgaaaacatggataatgaatggacgttaatgctaagtgatataagcaagatacagaaaaacaagtactatgtgatttcacttctgtggaatctaaaaagtcatactcaaaagcagagtagaatgatggttgccaggagccagaagatggaggaaatggggagatcttggtcaaaaggtacacattttggccaggcacagtggctcacacctatgatcccaacactttgggaggccaaggtaggtggatcgcctgagcccaggagtttgagactagcctgggcaacgtggcaaaaacccgtctctacaaaaactacaaaacctagccaggcatggtggtgtgcgcctatagtctcagctactcaggaggctggggtgggaggattgcttgagcctgggaggtagagatgggagtgagccatgatcacgccactgcagactccagcctgggtgacagggcgagaccctgtctcaaagaaaaaaaatggtagatattttcagttataagataaataacttatgttattataatttacagattctaaggatctaatataccgcatggtgactacagttaataatactgtatagcatatttgaaatttgctaagaagattttaagtgttctcaccacacacaaaaaaaggtaactgggtgacatgtattaattagcttgattgtggtaatcattttacagtgtatattagatcatcacaatgtataccttaaatatatataatttttatgtgtcaattataaagaaaatctttgatcattaaggaagctgaatatcctgctatatctaactcaagctgagaagggggaaaaagcacaatagctaacacttagaacactccaagttgtgttttaagtgcttttcatatattaaattcatgtaattcccataacaatcctgtgactgggcactattatcatcattaatctccatcttatattaatagatggggagactgagtgatagagaagtaacttgctttaagggcatggggcagagctgggatttgaacccaggtagcctagcaccaggctgcatgctctgccaggaggctgtgcttcctctgtagtaaggtggcctgtccctctcaactctttccatcactgggcacaaagctactgcatcagctgtcctccatatttaaaactcaggtatactctttgatgaaactctacctttagagcttctacccacactaccaagtcccaacaataccaaaacactcataagggatctggcccaaagcaaactgttccacattactacttggtagaaaacgaaaagctcctttttgatttttcacactctggacattttagtgtgtcatgacccagtctgataaccttttatgtctcttaagcattttgttgtgtttgtaactttttaccccctaattcattttcactgtcctgcaaagagttggaataaattaaatgtctaacaa

SEQ ID NO: 164147 - DNA, 4073 bp, Homo sapiens
  Payload ID: 12318
  Gene Symbol: PCNXL4
  Gene Name: pecanex-like 4 (Drosophila)
  ENST ID: ENST00000391611
  CDS Start-End: 555-1247
tcttgcgtaaaggcccggcccaagggaacgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggagcgcccagcccgagtttacctgcaaaaatgcggtccctgggatgccttcgcgtcttctcttccctcgggtgacttgagaaactgctgtgttacagaaaagcatgtgactttcagaataatcccgagtgaggatgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttataccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgtgtggtcttggaacatggtatctgctcccaaatagaataaccttgctgtatggcagtacaggaggcactgctctactattcttctttggatggatgacactatgtatagcagaatattctttaattgtaaacacagctacagagactgcgactttccaaacacaggatacttatgaaattattcctcttatgagacctctttatatttttttctttgtttctgtggatctggcacacaggtaaaaacctaccaaatactttgtaactaactttgtttttaagtatacagagtaagagagctttccttttagtgttacaaaaaaatgaatccatggattaaaaatcatcaaaccattgggtgacaggttattttgataattattcttttaggattaatctctgtaaaacatactaaagcaatagttaaaacttattaaagagtttttttaaaaaaccctttttgagataaggaacttttcaattttgtgtttcactttaaataaggagctttgagtttttaagatagcctggctaaaacctgtgtaaggagatggaactttcctgtggggggaaagaagaaattaaaatttatacatataaatattatatacagattgaatgaatttaagacaaatacaaaatttatttctaattttatgatagcaacaatagtagaagtaatattgattttttaaaaaccaacttgttacagaagaaaagtagaaaatagtttttttaacagacataattgttcacaaaattgtttgataaccccttttacttgccttttcaagtttgacttttctttctccgtctccgtagattgcagctttcttttcttaggttagtgtccaggtagaaatgttcagcatgttatggactgaatatttgtgtctctccagaattcatatattacagtcttaaaccccaatgtgatggtattttgagatgaggcctttgggaggtaattaggtcatgaaggtgggtccttggtatgatgggactagtccccttatgagaagaggtaccagagagcttgatttgtccctctctgtgccatctaaggacacagcaaaaatgtggccacctgcaagtcaaagaagagagctctcatcaaaacctgaccatactggcagcctgatcatggtctttcggccttcagaagtgtgagaaagtaaattgatgttgtttaagccactcagcttatggcatttttttatggcagcccatgctgattaagattttgctaccaagaagtgggatgcctttgtaccaaatacctaaaaatgtggaaatggctttgtaactgttggtaatgggtagaggctgaaagaggtttttttgtttgtttctttgttttgttttgtttgagatggagtcttcactctcttgcccaggctggagtgcagtggcacaatcttggcccactgcaacgtccgcctcctggcttcaagtgatactcctccctgagcctcctgagtagctggaattacagacatgcgccaccatgcccggctaatttttatatttttaatagagacagggtttcgccatgttggccaggctggtcccaaagtcctgacctcaagtgatccacccgcctcggcctcccaaagttctgggattacaggcttgagccatcacacccagccaagggttttgatgtgcatgctagaaatatggacattaagggtgattctgatgaagtctgaagtcccctgaacccagaggaaaggcagtccttgttacaaagcgtcaaagaacttagctgaactgtgtcctagtgttttgtggagccatgaagttggatacctacgtaaggagagttcaaagcagtgttgaaaggagcagttggcttctcctgtttctagtaaaatgtgaaaggagagagatggattgaagaagggattgttaagcaagagaaggaaccagaacttgaagatttggaaaattttcagcctggattatccatattgtaaaacatgagaaagcatattctgaagagaacaccaaaagtgtggggctggactgtccctcagtaaagagcttttggcattatgtgagtagaaacactgccagtttgaattgaagtggttggagacaggaagtaatgaaggccgacagttgaacttcttggatttgacaggatgtaatgatagaactgttcagctacaaaagtgcagtattcttcaagaaaaggggaaaattatgccaaaggtgatttaagggtcttgagggctaccacctgtttcaacaagtcagctagcctctacccaaagcctcgggagcagaactgaacttcagagccacagaagcaggaccctcacctagagcactggcggtgacctgccaccccagtggcctggtgggcagagtatggaaccaaacagaattattctcaagctctaagatctaatggaatttgccttgctaggttttgacttccttgggatcatcaccctttttttcctgtttctcctattggagtggggatgtctcttctatacctgccctacccttagattttggaagcacgtaactcatctggtttcacagattcacagctggagaggaattttgcctcaggatggattgtacctaggtctcatccatatctgatttagatgagactttgaattttagccatcagagttaatgctagaatgagtgaagactttgggggatatggggatggaatgaatgtcttttgcatttgaatttggaaaggacatgagttttgaggggccagggatggaatgttatagactaattgtgttccctcaaaaatgtttatgttgaagccctaacccccaatgtgttggtatttggagatgggcctctgggaggtagtttatgaaggtgagaccctagtctgataggattagtgcccttaggagagatgccaaagagcttgatgtctctctttttgctacaaaaagacacagcaaaaaggcagccatgtgtaagccaggaagagagtcttcaccagaacctgactatactggcagcctgatcttgtacttgtagcccccagaactgttagaaaataaatttctgttgtttaagcca

SEQ ID NO: 164148 - DNA, 4666 bp, Homo sapiens
  Payload ID: 12318
  Gene Symbol: PCNXL4
  Gene Name: pecanex-like 4 (Drosophila)
  Uniprot ID: Q63HM2
  ENST ID: ENST00000406854
  CDS Start-End: 555-4073
tcttgcgtaaaggcccggcccaagggaacgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggagcgcccagcccgagtttacctgcaaaaatgcggtccctgggatgccttcgcgtcttctcttccctcgggtgacttgagaaactgctgtgttacagaaaagcatgtgactttcagaataatcccgagtgaggatgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttataccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgtgtggtcttggaacatggtatctgctcccaaatagaataaccttgctgtatggcagtacaggaggcactgctctactattcttctttggatggatgacactatgtatagcagaatattctttaattgtaaacacagctacagagactgcgactttccaaacacaggatacttatgaaattattcctcttatgagacctctttatatttttttctttgtttctgtggatctggcacacaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaata

SEQ ID NO: 164149 - DNA, 3513 bp, Homo sapiens
  Payload ID: 12318
  Gene Symbol: PCNXL4
  Gene Name: pecanex-like 4 (Drosophila)
  ENST ID: ENST00000406949
  CDS Start-End: 507-3128
aaaggcccggcccaagggaacgttcagggcgtctcggctttccccgctgctgcttctgctaggcccagtgcgagaccagagcacgagcgactcccgtcgtccccggccaggcagatgttggcctagtcctggcgcgaacgaagcgcgctatttccctgcttcctctaggccaagcctgctttacggcagggcccgcctcgggagcgagcacagaccggggcagcgaggccagccaggcgccgacgaggtccccgaacgcgcacgcgctccgttcagctccgggtggcggccgccggagtagacgttagccatggaaaccgagagctggcccgggcggggccgcggtgagctcgttattcggccgccgcagcttttctgcctccgcattcgggcactaaccaacctcccggcgggagcgcccagcccgagtttacctgcaaaaatgcggtccctgggatgccttcgcgtcttctcttccctcgggtgacttgaggtttgtggtaaatatgccagctctagaacacatgaatcagattttacacatcttgtttgtatttttaccctttctgtgggcacttgggactctgcccccacccgatgcacttctcttatgggcaatggagcaggttttagagttcggccttggaggctcatctatgtcaacccacttacggttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccggaaaaacatttttcatggaaggaatgccttttctacatcattatattagtcttggctcttttagaaactagcttgcttcatcactttgctggcttctcacagatttctaaaagcaattcccaggctattgtgggctatggtttgatgatattacttataatactgtggatacttagagaaattcaaagcgtatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgccaggaccagccttggagataagcagagtgaacagaaatttatggtctcagatttaagaaaaacaaaattctttcttgcttcttaaatcatactccatcccattggcttgcaaacatgctgacactcctcataatttcactcttcataaaccaaagcataaggtcagaggagaacttgacatattagaacacttaggcattgaaagtggttagtctaactaacccattgaagttttggagaacctgggactcaaattttggaagatgtgacagatgatatgttaacatacattgcaccgaggctgaagtgggaggattgcttgagactgcctggaaggcagaagttgcagtgagccgagactgatggtgtcactgcactccagcctgggcaacagagcaagaccctgtcttaaaaaaacaaaacaaacaaacaaaagaaacc

SEQ ID NO: 164150 - DNA, 2545 bp, Homo sapiens
  Payload ID: 12318
  Gene Symbol: PCNXL4
  Gene Name: pecanex-like 4 (Drosophila)
  ENST ID: ENST00000555740
  CDS Start-End: 1-1584
ttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgtatttatgactatgcatcgctgaggcaacagatcagaaaaggcagacaaagagaagtgactaagattttgcctaatggtgattgagatggctgccaggaaacttttatttaaagaaccaaggaagtagagggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttc

SEQ ID NO: 164151 - DNA, 711 bp, Homo sapiens
  Payload ID: 12318
  Gene Symbol: PCNXL4
  Gene Name: pecanex-like 4 (Drosophila)
  ENST ID: ENST00000556360
  CDS Start-End: 1-419
caagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgc

SEQ ID NO: 164152 - DNA, 357 bp, Homo sapiens
  Payload ID: 12318
  Gene Symbol: PCNXL4
  Gene Name: pecanex-like 4 (Drosophila)
  ENST ID: ENST00000554534
  CDS Start-End: 1-357
tgtatcaacagtacacttgatctccagtacagacatatggtggaacagaagcctggatacaggactcagactcttactgagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatga

SEQ ID NO: 164153 - DNA, 711 bp, Homo sapiens
  Payload ID: 12318
  Gene Symbol: PCNXL4
  Gene Name: pecanex-like 4 (Drosophila)
  ENST ID: ENST00000555929
  CDS Start-End: 1-290
tgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctca

SEQ ID NO: 164154 - DNA, 3750 bp, Homo sapiens
  Payload ID: 12319
  Gene Symbol: PELI1
  Gene Name: pellino E3 ubiquitin protein ligase 1
  Uniprot ID: Q96FA3
  ENST ID: ENST00000358912
  CDS Start-End: 444-1700
ggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataattgaattcgtctctgtgagttcatttttgcataatcgagaatgagaaaccagaagtgaaaactgtgaacaactctattccacactccaaaaatactcatttgaaatagatgaagagtttgcatttaatgtaacactttaaagtatctggttcttttttaaaagcatctcttactaataaaggaactttgttagtggttgaataa

SEQ ID NO: 164155 - DNA, 5909 bp, Homo sapiens
  Payload ID: 12320
  Gene Symbol: PELI2
  Gene Name: pellino E3 ubiquitin protein ligase family member 2
  Uniprot ID: Q9HAT8
  ENST ID: ENST00000267460
  CDS Start-End: 287-1549
ggcgctcagcgcaggcaggtccccctgctgccgggtcccatttgttgccggctctgactcggggcggccgcggcgcgcggagctccggggagtcaggcggagcagccgcgcagccacgacggagcagcagcgggactggccgccccgcgcccccttcgccgccgtgcccttccccggcgcgctcaccccgttctcgggatgggattgtagcggcggcgcggactcggcggggatcgcggcggaggcggcggcgtcggcggcggcgtcggcggccgagcggggctccatgttttcccctggccaggaggaacactgcgcccccaataaggagccagtgaaatacggggagctggtggtgctcgggtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccccgacggccacatggatgggctcactactaatggcgtcctggtgatgcatccacgagggggcttcaccgaggagtcccagcccggggtctggcgcgagatctctgtctgtggagatgtgtacaccttgcgagaaaccaggtcggcccagcaacgaggaaagctggtggaaagtgagaccaacgtcctgcaggacggctccctcattgacctgtgtggggccactctcctctggagaacagcagatgggctttttcatactccaactcagaagcacatagaagccctccggcaggagattaacgccgcccggcctcagtgtcctgtggggctcaacaccctggccttccccagcatcaacaggaaagaggtggtggaggagaagcagccctgggcatatctcagttgtggccacgtgcacgggtaccacaactggggccatcggagtgacacggaggccaacgagagggagtgtcccatgtgcaggactgtgggcccctatgtgcctctctggcttggctgtgaggcaggattttatgtagacgcaggaccgccaactcatgctttcactccctgtggacacgtgtgctcggagaagtctgcaaaatactggtctcagatcccgttgcctcatggaactcatgcatttcacgctgcttgccctttctgtgctacacagctggttggggagcaaaactgcatcaaattaattttccaaggtccaattgactgacgcccttgacagccatctacgactttattaacaggttactgtgaagattttgccactaactctagattttacctttttgtaatgctgtttatcagaggagggtgacaggggctggaaataaagagaggggacatggtgatgaaacatggcaggagtgtaacagataccagtggtgtgttgcatgctcaaaacagcagcgtcgtcattgaagtctgcttgattaaaccataatatctttgtaataattggatttaaaatgctatgcttctatttttaaccttgggtttttaaccaagtttttttttttttgtaatcttggacaagactttaaatcatattttacagatgtagaagaaatttattcaaaagtgtgggctcatgaagttcacttcagtgcagtgtggtgtaggtgttacgcgaagggcgcacagtgtctagaaatacttgatcgtggctcaaacctgaccagacagcagaggggcggctctgtacagtgtgactggtggacagatggccttaggcacaggtggttttgaaatctggggctttttctgatttatttttctgacttgttgggggagagaatattcataacttgtgggctttttttttttttaacttcagtggaatttactttagatattcattcatcaaatacatgggacttcacaaacaattttccataactttttagcctgtcttttgttatttctgcctaatatgatttgccccgatactcatcttgcacggccagaactgtttggttgattaaaatacatcagctcttaaaaactcattaactgagggtaattacagtagtagacatggtctgggtactatactaccatgtttatttgctgactgaattaagatttaagaatgattaaaaataagcttttactttttaaaaccacttgaggtttcataaagcttggggtttttttttttcctttgttaagaaagccaaccaatcacaatgatatagtcattgttgtgcactcccttttcaccatctgtcaccttcccttgcagcttaaggagcccagtaagttttgaaaatgtttgcgaatcaaactaaatttaagtgggatgattagatatacacaacaccaagtggtacatctgcagagataattcaaaattcctgcttttgagagagcaaatgagtgttgctgaggaataattaaatgagaatttcataggagctccaccattcctgttactttcatttcattttgattaataattcttggatgcttggcatcgatcgtatcactgctcctagaaggtaaagatcctttaggacatgagactggtagaagctggctgagataaaataagtatttatttaaactaatgttctcttaatttgaccattgcagatttgggtgacttttttttaacctttgtacatatacgtaatttatatgattctaatgtactatatccatacttgaattggttttttcgtattttgcctactggcaaatattttgcctattttcagtcgttctaacctatttgaatacgcttttccttaaagtgatacgataatattactcttgattgctgctgcttaatttgatgtaatatgtttaaagttcagcctctcagttttaatatagctttatttttcagtggagatcattgtttaggatgagacatttttggttttggttttgtttgggtaaattttaaatggtgtgaaaatcgatgacaacagtcctcttacagatagcttgctgtattctgtatagcttactctacctgcagacagaaaatgaaagaaaaaaatggacttgcctagaataatatattgaatgccttttgatttagccagagtctctgatgattagctttcactgatagagtatgtcttttcagcctgtaattctttgggccccaaagaatgacaaaggaggcactcgttctcttttcttgctgtatgcctagaaagtggttgaaggattcttgatgccctaaaaccatcttgtaagctaaatggtcttgcatccagaaaggccagattttacctaccaagaaaaaaagatatttttccagagagttaggtatatcataattttccatttcaagtcctgtttataagtctagtcattctgcaacgtgacatatcccccaaaatgaagttaccttccaagttggacacgtcccgtagttgggcatatgtctaactaaaagtttctgacttttagtaaattcagcttaaatataagttgaaatttgggaaataatttccaagctcttggaaggggtaacagtgaaccgccctccatgggctccacatcttttcctttggcttccaaagtcaggtcccgcccaccctgcctaaggaactgcagagaggtggcaaatcagcaaaaaggacaccaggctcttcttggccacttgtaggaagatccctttacaattttgactaaggagattttttttttcacagttgagttagtttgtgaaaataaagaactctgtagctcaccaaggtggagaaacgcaattcagaaaagtaatttctccaaggtcacttctttttttatgtcttgccatcactttaaaggactagccccactcccccatgtgtatacacaaggaaattgcagaccaattagttgtcttggcctgactctaatgccttttgcaagtagctttccagaagtaaaagtcccagtgatgtattcccatagaaatatttttcagttgtttatgtcgtttactacaaaaaaaaagattcagagtggatggagtacaactctgagtatttttctagtccggaattttttattaataatcggtgctgccgggtcatgcatgctgcaactctcaacatttcccttatttggttcagcttttagcaaaaagggctacagttcaccctgcagagtattaaggtttctggatttttttctcccaactgtggcccaaaagaattaaaatctgttaatataaatagagaacatatttatcattcctcgatagttaattatagactttggtacctttgtgcctcagggaagccacgtgatataactggttatagaatttcagggttagggtttaaagaaaggagaaagccattggaaaaatgatgggctccattaaggagactaatgaatctggatgcagaaatatgtcagaaactggcataaacatgattgtagtagaatttattttccagtaccaatagggaaattattttaagttattacatttactgtattgggaaacttgaggagaactctttagttcataaagcttcaatgtcttttttttttttttcatggaaaaactcaaacctctgttatttgggagctcagtattgtgtggacacttacgagagttttctgcttaattgaagtgtaatataggttgtagaattgttacctgcagttctatggttttgtttcacttcttttcttttttaaagccattctgttctttggatgtgcttgaaagggtgtgtgattacaccattgttaatgctgggtaaaaactatcttcttgcagccttgcctcataacagtggaatttctgatagacaaaccacaggactttgattttaagccaaatccatctccatccctttactgtcaatcttctgtcccagtagtttagcctttgtggcttaggttatgatgcgcctccttctgtgcgaccaatgagacgacttcagcatctttttaaaataatctaagcatcattgaagcagtaacacaaaaaaaaggttcagtattttctttttagtataacttacatcctttcaaataagtctttgccctcatgaagaatccctagaggaagataaggaaaataagtattttccagttttgcttgacagtttctaaacaaacaaaaataaactcaatgaaaggaaagatgtttctttttagctgagatgacagattgcttctctgtattaaatagtctagaagttaaggggatggtcacatttaccatgtattgtgttattagcagttaaattttatgaatatgtttgtaaaattgttgttttatatttcatgtcaaattgaaaagtttatttcttcactattgtacctgtggaaatacaagccattttacaggaaaaaatcttcaaaaactattaaatggatatcagcctgtttgtgagccattgtcttcagattctgtggttgtcactgagttcattaggacatttagtaggttgatacgagtagaactgatttttttcacttctctaacttccaagttaatctccagctgttgagtttattaattgttttatattctgcacaatacatatttaaaccttgattctgaaaatcccctacattttttaattaaagaaatttccttggtgcctata

SEQ ID NO: 164156 - DNA, 774 bp, Homo sapiens
  Payload ID: 12320
  Gene Symbol: PELI2
  Gene Name: pellino E3 ubiquitin protein ligase family member 2
  ENST ID: ENST00000559044
  CDS Start-End: 491-774
aattttctagacgcctttctgcttggttttggaaggggaggcacccaagtgggtgtgtgcgacacctctagttgtaagccgggacacagtgacgtcgagagagcgctattctactcggagaggaagttaatcccatcgaactccagccaggaaaacgtgggcttgggaaccgcggccgctcgtttccaggatctcccgcgggccttcgcggctgaagaaccaggcggcgagggctgaggaccccgcgctctaagtttggggaaggaagtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccccgacggccacatggatgggctcactactaatggcgtcctggtgatgcatcc

SEQ ID NO: 164157 - DNA, 558 bp, Homo sapiens
  Payload ID: 12320
  Gene Symbol: PELI2
  Gene Name: pellino E3 ubiquitin protein ligase family member 2
  ENST ID: ENST00000561019
  CDS Start-End: 326-558
atgtgaggcgccgcggtcgcgggcgcttcgcggggtcgcttcccgaagctgagaggccggccggcgcggagccccgtcttcccacctccctcgcggaccgtggtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccc

SEQ ID NO: 164158 - DNA, 2783 bp, Homo sapiens
  Payload ID: 12321
  Gene Symbol: PELI3
  Gene Name: pellino E3 ubiquitin protein ligase family member 3
  Uniprot ID: Q8N2H9
  ENST ID: ENST00000349459
  CDS Start-End: 285-1622
gaaggggcggagctccgcctacgaaggctgagcatcgccgcaagaggcggagtctggagcgaggcggagctctcctaggggcggggaaaatggggcggggcctccggacagggggcggagcgtggctgttcgcgctcatccccctcccccggccctgggtgtccccgtgacgaggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagca

SEQ ID NO: 164159 - DNA, 2740 bp, Homo sapiens
  Payload ID: 12321
  Gene Symbol: PELI3
  Gene Name: pellino E3 ubiquitin protein ligase family member 3
  Uniprot ID: Q8N2H9
  ENST ID: ENST00000320740
  CDS Start-End: 161-1570
gctgttcgcgctcatccccctcccccggccctgggtgtccccgtgacgaggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggatgctgtgaggaaggaggtgaggaaaccgaggctcagagaggggaagtgactggcccaagggcacacagctgctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaga

SEQ ID NO: 164160 - DNA, 525 bp, Homo sapiens
  Payload ID: 12321
  Gene Symbol: PELI3
  Gene Name: pellino E3 ubiquitin protein ligase family member 3
  ENST ID: ENST00000527230
  CDS Start-End: 169-525
gtgctgcagcccgagctcgaggggggagcgccgcctccgcaggcctcctgagacccgggcggctggggacgcagacagacacctgagggagggaagagcgcgcacccaggaggagtctattggcctacccgcagggggaggccgagatggggagactgaggcagatgaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggatgctgtgaggaaggaggtgaggaaaccgaggctcagagaggggaagtgactggcccaagggcacacagctgctacaatggttgtctggcaagtggggacaagggccgccggcgaagccgcctggcactgagccgccggtcgcacgccaacggggtgaagccagacgtcatgcaccacatctccacgccgctcgtctccaaggca

SEQ ID NO: 164161 - DNA, 2572 bp, Homo sapiens
  Payload ID: 12321
  Gene Symbol: PELI3
  Gene Name: pellino E3 ubiquitin protein ligase family member 3
  ENST ID: ENST00000532970
  CDS Start-End: 112-387
ggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggctacaatggttgtctggcaagtggggacaagggccgccggcgaagccgcctggcactgagccgccggtcgcacgccaacggggtgaagccagacgtcatgcaccacatctccacgccgctctgacttttttctccccaccaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccat

SEQ ID NO: 164162 - DNA, 1671 bp, Homo sapiens
  Payload ID: 12321
  Gene Symbol: PELI3
  Gene Name: pellino E3 ubiquitin protein ligase family member 3
  Uniprot ID: Q8N2H9
  ENST ID: ENST00000524466
  CDS Start-End: 106-1101
gcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggatgctgtgaggaaggaggtgaggaaaccgaggctcagagaggggaagtgactggcccaagggcacacagctgctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtaggtggcccgctccattccccacccctatccttgccaggccctcacaagctgcccatccccctgcccaagccaggagatgatctccagtccttctgccccagggagccccaacaggctccatatcagggaatcccaggcccagggggttcttagcatgagccacttgtcccacagacaggcagacagaccagggtccccaagcatagcatgcataccactggaggtccagggggtgatgcgatcaaggcacacacagacatactgtgcagtcccaggtggcttcaaggctgctggcagcttaaaaaaaatcacaccttcttatgagagtgacacttggcccatgtgtgagcagtttatagcctaaagggttggcagtttgtagcatgtctatcacgttcagacaggtttagcactgttctcctctcgcaggaggaaagggtccttacagtagttctgacacaggtgttagtggcagctccttgtggtacagatcagagagctgaggttagggaccgggagtgagtcctagagagaggcaggggctgtccaaggtcacatggccgtgctcctcaaactggccatgcactgctcttctctggcatgagcacattggccaaggagatgcaaaacctcagagaaaagcctggcttttctttccagagcgtcaactctgtggggaggtctggggaagcattgtttgttaaaacaatgcatgtgaatgtt

SEQ ID NO: 164163 - DNA, 1967 bp, Homo sapiens
  Payload ID: 12321
  Gene Symbol: PELI3
  Gene Name: pellino E3 ubiquitin protein ligase family member 3
  ENST ID: ENST00000528752
  CDS Start-End: 1-204
atcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctgtaaggcccttctactgcctctggcaggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaga

SEQ ID NO: 164164 - DNA, 964 bp, Homo sapiens
  Payload ID: 12321
  Gene Symbol: PELI3
  Gene Name: pellino E3 ubiquitin protein ligase family member 3
  ENST ID: ENST00000526296
  CDS Start-End: 200-964
ggagccgccgcgggccgggcccatcccgccgcagcggcccggggccgagcaggggctaggcggggagggagcggcgcccagcggggcccggagcgtggccagctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgc

SEQ ID NO: 164165 - DNA, 2508 bp, Homo sapiens
  Payload ID: 12321
  Gene Symbol: PELI3
  Gene Name: pellino E3 ubiquitin protein ligase family member 3
  Uniprot ID: Q8N2H9
  ENST ID: ENST00000618547
  CDS Start-End: 121-1341
agacaggtctgcgactctggtcaactgcagctgctttccccggcctccaccgctgccgcacaccccctttgcctttagcattttcctcctctcctctaattgcgtggcgtccccagatgaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctcc

SEQ ID NO: 164166 - DNA, 4349 bp, Homo sapiens
  Payload ID: 12322
  Gene Symbol: PELO
  Gene Name: pelota homolog (Drosophila)
  Uniprot ID: Q9BRX2
  ENST ID: ENST00000274311
  CDS Start-End: 986-2143
gatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggaattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgacagggatggaagagaaaacttaggaagttgaagtttggcattaaaataaaggactcgccaccactctgtgcaccttcttgagggagttcattcgtccggagcgcctcacagcttagtgcgcctgcgcacgcgcgaactgcggccccgcctctcctttggggacgggagacgtgcgtcgggtcgcgggacgggggctgcgcatgcgccttcatttcgtcagcccgctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacctgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttgctatcttatcctgtttacattatttctttattttaattctgcttggtgttcttgcattgcatttaatgatcccttttctccccacctccacacactacattttttttagatttaaatagttttactattttaaatgattgccgtacaattagtagacttgaagacaagttttaaatatttttcttcaaaggcttgttaaaccaatcatgttaaaaggaaattcttggttttggtttgttgttgttagcattagtcatatttgatttagagggtaacttaaatcagttatttttagctttttagaactttgatctgctagggattgtcaaaataatctccttgaggcatctttatttttaaaatgagattaaagtatgtgatttgcttgttatgtggctaattagtggcaaagctggaagtcattcccagtctggactttagttctttgcgccaaaacatgctatattatttatttatttttttgcttgtcaaagttatacttaattctgttttatatttgtatgtggcattaatttgggtttgcacatttttattggactattttagttgtgaagaagcctgttctaaagtttaagtcacatgactagtatgtggcagttgacttaaactccaatactctttactatcattgacttaaactctgatactctttactataattatggaattgtgcaaatacctctgagtttaaaatattatttttattatttttggtgcacattcctaaaagttaaggaaggagcctcagtaatggaattgcttcttgaccttttgcaaacctcaatttagcaaaataattaggaacgatctaatagtgatgatacagtttttaactgctggatcagcgacgcctatttcaagtagtgatactaactaaactttcgccggtctttcctgtgtctgtgggccttcctcctggtgtgacagacttggggatttcttgtaaacttcctaactagtctgaacctttttatttcttattgggaactgacacttccctatactttaaaactcacatatgtatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatattttcagtaaggatttggagatttttggacatttttactctcataatctatgcagtactgaaatgaggtctaataaatataaccaatacatgttaggccataggttcttaaatttagctacctgttcacctcaacttgagagctcttaaaaccctcagtgtccaggttgcagctcagactagttaaataacgttttatccctagaaatgttttttttaaagctacccagatgattccaataggcgtcaaggctaatagccactgattcaggccttgctattcaaaagtatggtccgtaaaccagcagcatccctgagagcttgttggaaactagaattcagggatcttttgtagacctactgagacaggcgctacctgtaccaacatctctagatgattcctgtgcataataaaatctgataaacaaaggcaataggttattcttcctgtgctggtaaatctctggcaggggtccccagtcaggaaaaagatttgagtattaaggtctttcaaaaaagttaactggccatactcaactgtctataaaacctctataaatttctgtttttatgtctatgaattattaaataaaatttaactcatttttaagaaattaca

SEQ ID NO: 164167 - DNA, 1629 bp, Homo sapiens
  Payload ID: 12323
  Gene Symbol: PEF1
  Gene Name: penta-EF-hand domain containing 1
  Uniprot ID: Q9UBV8
  ENST ID: ENST00000373703
  CDS Start-End: 24-878
ctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctggagttc

SEQ ID NO: 164168 - DNA, 5582 bp, Homo sapiens
  Payload ID: 12324
  Gene Symbol: PTCD1
  Gene Name: pentatricopeptide repeat domain 1
  Uniprot ID: O75127
  ENST ID: ENST00000292478
  CDS Start-End: 252-2354
cttgcgcctgtccaggcactgccaatcgagactccgccgttccgctagtcccagctagccgccagccgaacaccggcctcgccagaaacctgaaaccagccgcgtgagtcggcgacgcggattgcgcctgcgcgcttggggagagggggacccgaggaagagactggttcgccgcggggaccgggcagggctccccgtcggagtgcactgcgccggacacttcaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcacgggacttccagctccagctacctttgtgtgtcacctcacacaccacaagggggctggggcatctggtccctggggcctgggccgccccgccgggttccataggccgatgctctgaaagaagagacgtggggctcgagagatttaaagattttatttttacaaatcacagctgatagacagcgaagccttccccatagagaccgtgctccaactcgggcctggggcactgctcgctgctcccaggaagggggtggcgtgacaggcaggaacctgcgaagtccagagtccagggtggagcgcgccagcctcagccagagcagccacgacagccacagtgtgtgcactcgatgatgcggccctgcaacggaggaggacagtgagacgatgccactgcgccacgctcgcccctgcacactcacatatgtggcaaccctcccacgaaggacctgccaccatgccatatagggacacacctcagaaacccttccttgacagctctggacagggaaaatttggctccctcatgaaggtagaaccagctgctgttgacaccgaggttacatctgtatgtctatttataatatgttctgcaaatccaacacacgtttgccaatcaagaaaaagaaatcggtgtgaatgagtctcgttattctgctaagtgagcatgacagaccctgcgatgagcagacgtggctctgctactgtttggggacttcaggggggcctctgggctggtacactctggtgggggaagagggcaggagactatgcacttgagtcacacccttctggcccagagccccccagaaagaagggtcttgtcccccaggcctggtgcggcccaacacttggccagccagaaagccctagaacagtggcttgtgtttattttactttttcaagttctttttttggaagaacaagaccatagtttaagtaaacaggatcctctggtgaaacccaggtaagtctacagcgggctgttttggccacagggctgaagcagcaccccagcccaccagcccctgacctggactccttgtggaatctgggcactcagaggaagggggcttctgccactctgccacctgtccctgcctccatcagaaaaccaacaccccagtcttccgtcggggaggcggcccttgctcgcccccactgctcagtacccaagtcctcagcatccagccacagctctccattgtcagtctcactgcagcataaaggggactcatgtgaagaggcccctgtgtggagctggggaaaagaaggccaggctggcagatgggcggtggggccaacaactgtgctgaggggctgcactgagcggccactgctgtgactctgcctcgggccacagctgcctttcagaggggcttggaaccggatggagctcagctcctgtccctcagcaccactcctgaggcgcctggcctaggagtggtacttggaacagaaagttctgaaagaagaaacacagtgggctgggcgcagtagctcatgcctgtaatcccggcactttgggaggctgaggcgggtggatcacctgaggtcgggagttcgagaccagcctgagcaacattgagaaaccccgtctctactaaaaatacaaaattagccaggcgtggtggtgcatgcctgtagtcccagctactcaggaggatgaggcaggagaaccgcttgaacccgggaggtggaggttgcagtgagccaagatggcatcactgcactccagcctgggcgacaaagcaagactccgtcttgggggggcgggaaagatagtgatggtaatgttaaagtatcactgtgaggactgaaagggacaggaactcactggttgtccttccctgatgtcaccctgccaccaccttgggattagggctccccaccaccatttcctaagtgaggaaaggggttcagtaatttgcccaaaagtggagttgagattgaccccagacctaacaaacacacagccacacgctgcctcacatggattcctgaatacagggacccactcccacgagggagagccagcaggacatccagggacaaaacgacattccagcccaaccaaataacataagatcccttgcagtcgactaaggcagaattttgagctgaaaacaacaccaagcttgagtgtcagacattaccacttccagcttgcttttgggcacgcggcagatgcagttcgtcccgaagttggtgtcccgtgtctgaatgcaccgcaggcagcacaagttctcatatccttgctttttccattttgcaatcaggtttttgtctgcatagccttctttaatacaatattcatagagttctgtcaaaaagatggggaaagagcatcaggccatggtctaaaaaccttccccacccttgatcaaaaaaagcattcaggccgggtgcagtggctcacacctgtaatcccagcactttgggaggccgaggcaggcggatcacctgaggtcaggagttcaggaccagcccggccaacatggtaaaaccccgtctctactaaaaatacaaaaattactcgggcgtggtagcagctgtaatcccagctacttaggaggctgaggcaggagaatcacttgaacccaggaggcggaggttgtagtgacctgaggtcgtgccactggactccagcctgggtgacagcgaaactccatctcaaaaaaaaaaaggcattcagtattgcaacgggacagtccttggaggaggaacaaaaaaaaaaagtacttaggccaggcaaggtgcctcacacctgtaatcccagcacttttggaagccaacgccagaggatcatttgagttaagaaaccagcctgggccaagggcccatctccacaaaaaatttaaaaattagctgggtgtggtggtgcacacctgtagtcacagctactcaggaggttgaggtgagaggatcccttgagcccagaaggttgaggctgcagtgagccatcattgcaccactgcactccagcctgtggaacagagcaagaccctgtttc

SEQ ID NO: 164169 - DNA, 571 bp, Homo sapiens
  Payload ID: 12324
  Gene Symbol: PTCD1
  Gene Name: pentatricopeptide repeat domain 1
  ENST ID: ENST00000430982
  CDS Start-End: 80-571
cagcggacaccaggactccaaaatggcgtcagttggtgagtgtccggccccaggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctg

SEQ ID NO: 164170 - DNA, 533 bp, Homo sapiens
  Payload ID: 12324
  Gene Symbol: PTCD1
  Gene Name: pentatricopeptide repeat domain 1
  ENST ID: ENST00000419981
  CDS Start-End: 216-533
gactggttcgccgcggggaccgggcagggctccccgtcggagtgcactgcgccggacacttcaagtgagttcctgtgtgatcctcgcaggagccccgggacccgggccaagacacgccagaggggaaggaagtgcccgagccgggattggagccgggggcgtctgaggagggaaactgaggctgcagaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgca

SEQ ID NO: 164171 - DNA, 556 bp, Homo sapiens
  Payload ID: 12324
  Gene Symbol: PTCD1
  Gene Name: pentatricopeptide repeat domain 1
  ENST ID: ENST00000430029
  CDS Start-End: 124-556
aagacacgccagaggggaaggaagtgcccgagccgggattggagccgggggcgtctgaggagggaaactgaggctgcagaagtccgtgtggagaggggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaac

SEQ ID NO: 164172 - DNA, 2195 bp, Homo sapiens
  Payload ID: 12325
  Gene Symbol: PTCD2
  Gene Name: pentatricopeptide repeat domain 2
  Uniprot ID: Q8WV60
  ENST ID: ENST00000308077
  CDS Start-End: 11-1177
agtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaaa

SEQ ID NO: 164173 - DNA, 11151 bp, Homo sapiens
  Payload ID: 12325
  Gene Symbol: PTCD2
  Gene Name: pentatricopeptide repeat domain 2
  Uniprot ID: Q8WV60
  ENST ID: ENST00000380639
  CDS Start-End: 17-1183
ggttccagtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataaggaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaattttaccgtgtctggtcaccagtgagcagaagatacacagtgaccccacctcacttgctccttttgtttcagaaagcccagagggttgctcagacctcaggagctgtctgccaagattgctgcagactcttcattgccacctccaaaactaagactgttcacttggttgttgttctaaggcaaggattatagagtcagaaattgtagactaggagaagtcttctgagtctcctaattaattccttcatctttcaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaaagtgcttggatttctccactttcagtcttagggaataatagggcatgcttcctgtccccccagcttacttttcatcttctccaactctcacagttcaaatggctccagtgctgtgggtgagtgtggccttggttgttagctaacaaccattcattagcgaaataaccaaattttgtgagcagtaaatagcaacaagcttcccaatccctgctgcccagccgactggaaaaactggtccattccacctgttcccagaaacctcagtacagaggtagctatatgcataatgttcaccccaaagtaatagatgattttaaagtcttaaaagtccaataaaacagtgttcagtataggttatgataggcatttcattctttaaaactcagtaattcctttgaaaaaatgatgtttctttataagcagtagtttgcctacatcatttacttgtttttttctgctttggggtttttttttttttgagacacaatttcactctgtcgcccaggctggagtgcagtggtgtgatctcagctcactgcaacttctgcctcctgggttcaagcaattctcatgccccagcctcccaagtagctgggaatacagttgtgtgccaccacactggcttattttttgtatttttttagtagagatggggtttcaccatgttggccaggctggtctctaactcttatcctcaagtgatctgcctgccttggcctcccaaagtgctgggattacaggcatgagccaccgcacctggcctacttatcctgttaatgaaaatatttgattggacagaacatcttattccttaactctgttatgtgcttttgtagattgtttttacttactgtagatatctgttgctccagagtcccagaaatcagtatgatgagttcagcacagttactagaaggagacaaaaagatatcttcttaattaggtgatatcagggatagttctggttattgattgctgtgtggaaaacactccaaaactcagtgactttaaacaacaccagtcattgtgttatttctcattatcctaagtactgactgggctcagccagacagttcttattcgggttctcatgcagttatagtcatcatcagattgtggccgcgactggcataatctcaaaggcttccttagtatttctggcagttgatgctaggacctcagctagtgctggggctggaacatgtctacacatagcttccccacagcatggtggctaggtactaggagtgactgtcccaagaggaccaggcagaagcagttacattttatgacctagtctcagaagtctcataacatcacttccactaaagtcccaagcccccccagattcaaatggagggagcatatatcccatctcagtggtaggaatttcaaagaataaattctgtgaaactgtagtagatagtctgttttctcccctgtttaaaacctcctgaggacctcacatgcttctggataaagctcaggctcttcaacatggtttagaaggtccttcctaatctggcccacatttgtccatccagctccaactcttgctactctacgcccctcttcccctcttgtggaatggctaattcctactcatcattcaggtcttggcttagacatcttttcatctgagaaggctttctggtctagtctcacctggttaggtgaactccccatgtgccccatgtacctcatttatcaaagtgcttatcatatgcctgtcactgtctgttttcttcactagactcaggtgccatgtctgtcctttctgctctgtttgctgggtgcctagcatggtaggggatgtatcagaggattagtacttatttaactcaccagctcatttaactatattgtataacaatgttggtggtcatattggtcccccatggacagcttttcgtctctaataccatacactcagtgcagggtctgaatgtccccccaaactcatatgttgaactccaaatccccaaggtgttggtattagatgatgtagcctttgggaaggaattagggtggtgccctcatgaatgggatttgtgtcattataaaacaagcccaaagaaatttggtcaccccttcctttaagcgaggtcatggcaaaaagacgctgtctatgaaccagaaaatgggctctcactagacaccaaatgctggtgtcttgttcttggatttcccagccttcagaactgtgagaaatatatttctgttatttataagccacccagtttttggtattttgttatagcagcctgaagagactaagacagccagtcccaaccttccacatttagacctgactccaagttttgctcagcccactgtgtatcccttcctcctcccaaccaaagtgtccccactctttctctattctgttctgcctattattcaaggtctaacttgtgtcactttttcaatgaggcatttgcaagctctttaaattctcaaggattctccattaattcaccatatctattttgagaatctacaaaggacaaggcactacgaaagactctacatgccacagggaaaagacagacaagatctctgtcccaacacagaaaattttagcctgccatgttgactcccagggatctttttgtttctgtaggaggtgctcattacagagtggccaaattcctactgaagaatggacttggttgtgaaataaaacaatcctgggcaatatttgttgatagttttgttgaggatgattcaggaaataaatacaaacttttaactactcataatgaatattgttgggatattataatgaggaggtaaggatttacctgctacaatttgggtaggcaaaaatgtaggcttctctgtttctttgcagtgaactaaaacttcttatgaactctggttatactgaaaacaggagtcatgggagacttgatcttgcttaaaggatattttagtctttgatttctttgaggtaaatgttcaatctttttgcgtatcttcctcctaccttttcatagccaagatgacagctgaacaggctctcatcttaaacctgaacaggcatcagaatcacttggagagcttgttaaaatacagattgatgggccccacccccagaatatctgattccatacatatgagtcagggcccaagaatttgcattacaaatgcattctcagatgatgcctttgctagtctgggcaacacactttaagaatagttggtataacagaaagcttgtgtgtcttgtgtgtctatgtggacaggagttgtgggcttcagattcatcctctgtgtcctctggtctcagttgtgaggagggggaagagtgggaagtctggccttgtctctggactcctgagtaaataatgtgctgatgcagtgttgggcccagcaggccttttagagggtcatgccagcacccactgctgaggtctgtagtctctaccatctgccctacacataataagtacccttcctctgctattctctcttgctgaccccaagcccaccaatgaattaattgaatcaagagttccaaggcattaggttaaagacattgaaaaatatatccatttattttttcaaatatacataaagaaatccatacaaactaaggccaattgtggcaaaactacatgagacttgactaaaataacccacaattcaaatttccttcataacatttctacctataaatttgattcagagaaattacacttcatagataaactagccataaaaaagattacagcggcaaaagctatcatcagtaatatttgatatgcataagaaaccgtgaggaaccaaatcatggtaaaattgattctaaggaaatggttgcacaaaaataaaagtgaaatggtattttttaaaaggaagtggttcaactgtattgcatagaaaatgaatcaaggaattacattggcttaaatggcattagctcaaaaaagtgttctcaaaaattaatggaaattggtgtattctgattgagatatgttttattcaataacatggagtcaaaacaagaagattttttaaatgtcctctgttcccatggagcttgcattctgcaagagcaacagacatcaaaaagataactgggcaaatgaccacatgattgcagttgggataagtgctaagtctagggtaatcttcatatcaccctgtggcatgtataaaggaagaccttttgctggtgttttgtaaaaccagttgtctgtgtcatttattttaacatgtaaagtacactgccttgtattgttacagatctttttctccatatccggtctctcctgaagaacagagtattctacatttgttttatatgaccccaaggtgcttatgtagcatattatttatacatctaatgaggtcttaatattttttgaaagagtgatttcattaattaacggcagattttagttaatatgtacagtctgccacaatatactttaggcatttcacagttttctcataaactggttgctgtttctgtcccggttttacacatgacagagccaagacacagacaagtagaatgacttgcctgtgcgggggtcctgggttggccagtgcattcatgtactggaccagggcccctgtatcttgcagtaatgtatccgtgggcgtttccccccagacattcgaagcacacagctaatctgagaaagaagtgatttggcgaggggttgggggagtaggcggtgggcacaacggttccaggtgactttcaagttgctaatgaaagaggatcaaagcgctgctgaactgctcacctccccgcttggcctgccttgcccagctgactttcttccaagggcctcagaggcagcattaccacaggcattaaagatggggatggggaaagaaggcccagagggaaagggaaccacatgcttacctgctaatcactgccctgcagctgaaacactgcagagctggctgctctgggataggagaggaaggcctcatttaatcaggagaagaaagagaaccaggggcctctgagatggcctgcaaggcatcacggtctgtgaactggtctgtgaactgcgggcctgcctggaaatgcattgtcagagtagagtgatgctttctttgtaaatcccttgtcttccctgattcctttttcctgactgaatcaggccaagatgctcacccagaagagcacagcatcaccctgtctttcaatccccaaagtagcccttacccctagacagcaacatcatctgttacaattgacagcatgaaggaaggcataacccctgcaaagtgactgccctacaactcaatttgattttgaatccgcaagtgcaagtctcattcctggtaactaatagtaacagaatctgctgatgtattctaccgcatcccagggagactcatgtagccatgaagactgaagaggattaagttaaccttccattttatagctgcaaattactgggttgatgtcaggtagggtgaggagtatgttccggttatagctggtagcaagatggctgcatgcatcatgaggctttggcctaaaaagcttgtcattatataaaaaagctatagagagcagagaaaatgtcatttccaatttagaagatcataatcgatttttaacacattggtccttaggtgatacagaattcaacaaaaacggggcttataaaaagccagggttcataaaattacaaagattatagacaaaaatagataacatataagacttaccagctgggcaaggtagctcaagtttgtaatcccagcacttagggaggccgaggcaggcagatcacctgaggtcaggggttctagaccagcctggccagcatggtgaaaccccatctctactaaaaatacaaaaaaattagccaggcgtggtggcgggcatctgtaatttcagctactcaggaggttgagacgggagaattgcttgaacctgggagacggaggttacagtgagcctagactgcgccattgcactctagcctaggcgacaagagcgaaactatgtttcaaataataataataataataagacttaccatttgccaggtcctgtgcaaagcactttatctcatttgatccctgggaaaccccataaagtactattatgccatttctcagataaagaaactgaagctcagagacgtttagttgcttgcctgtggatataacactagagagcgggagagcacagtatttgaacccaggaggtctgatgctggaggtcatgtttttaaccttatctctgtattgcctgcccaagtgctggctgtgtgcatgtattctcaataatccctggccaacttcctgctttgctgtcagtagcagagctgaagaacttacaatagacggcagagggcgtccagagtcactatttttaaaaggtgctagttttcaaaagcatttctggaattcagagagaacagaggtccacatagcaggctagacaggaaaggtagctgtagatagactttagggagtatatagaatattgccttcacgcaggttaagaaatatttagtgttgaaaggatacttttaaaagagagaaagcagtaaagttgatcctctgcagaaagtagaccaatgtaagtatcatgcaatgtgtccatgtgcgtgtacacgtgagcacacatgcacacacacattagatgttttgtgagaaaacatacactcagtttcttatgaaagaaaaaggatggtcatttgtctcacttgggaaagggtttcctcccaaattgagaaggaaaatccccccaattaactgtttgcctttattaactaaaatcacatttgtgtgtgaaagaagtaaaaaggaattaggatcttggttattttgattgtctctctacccttccagattcatcaaatgatagtcaaccttactgtctcttcctgccatcatcaggaatgactaaatcttggagcgttctccatttaagtgagggaaatgttggattcccggtgtatttatcactgcccatctctaagaataggtcaaagatgaaattcccattatcatgaaactttaatatatattgagacttcacagagcactaactatactggggctgggatggggattctgatgagagatatccctgacagagaccagagctcaggaggaagaaaggacagatgcccttgttcaagatgacttcttcatgggcatcgatagatacattcttgaaaaccacccaaagtacctagaggagaccctagtgcaactgtgcattgtacaacaactgatgaggtaaaagaaacaaactgttaatgactctaaacaatgtggcccacagagttggtatggtttggccacaccagctcagggataaaggtactagaaaaaatcttggggaaaatcctattgtacatattccttacataatgtctgtgatttacctcacttatcaaatgaaaaaaacccaaaacacctggttgatggccatttggtcaaacacctctaggagtctggagttgagtggccagaactcagtctttctttacatgctgtgttaagcaggcttttatctcattcaggtgttagaagtggagggaggaacacagttaggctgtgttctactgcactgcatagggaggcagggtatcacccaggcacaacgcccactttgcaagtaaataatcagtagcatgaagctcacttctgcaggacccaccatgacaaagtggagagctgggcggttaaccagtgaaccaattgagtggctctgggctcctatacccctttcattccacagcctgtgatacacccttagagtcaaaatatcaaattcagtgggccatgagtcttgcccaaaagtataaatctttttttcatatggactatttgggtctattttcaaaaatccctttttcttctctaaactatctcaattccacatttcactttgcaggtgtagacatgacttttaggttgttgatgatttaatgctattgaaatgttcttatatgcaaaacacctagatagatgcagagtgtgggacaaagacaaccagcacattgctaagcccaagtagcaaatttcctgaccccattttaaaggttctgagacagataggcggaataggtccccctgtctttgagtagaagagttggcaagcaagctggactaaatgggccatgtgcaattttgctgtctgttcacatttcaaataaactaatgtgttatga

SEQ ID NO: 164174 - DNA, 2648 bp, Homo sapiens
  Payload ID: 12325
  Gene Symbol: PTCD2
  Gene Name: pentatricopeptide repeat domain 2
  ENST ID: ENST00000486995
  CDS Start-End: 11-235
agtagttggtatggtccgagacagtatggctgctgcatttcggccctcgaatcgagttctcctgcaggcgctgcagattttggtgtatcctggggtgggaggctccggctctgtcagctgccgctgccctctcggaggtatccgcggctttagcctagggaaggaggggagggatgggagagaagggagtgttagatcccagctagcatctctgtggagcagccacagctcctaagtcactcactggcctggagcgcaccctcgccctctagttgcacgtgggtgcagtggtgaccactgggggtcgtggatacccccagtgcctgcaaatcgaaggactgctggggtattgaccttggggctgtagtgctccctcagatggggcgacgttcgtcttcaggaacatccctcccgccttgggtgacttttatttatttatttatttatttttgagacgaagtcttgctctgtcgcccaagctggagtgcggtggcgcgatctcggctcactgcagcctccgcctcccgggttcaagcgattctcctgcctcagctttccgagtagttgggactacaggcgtgcgccaccacgcccgggtaattttttgtatttttagtagagacgggtttcactatgttggccaggctggtttcgaactcctgacctcgtggtccacccgcctcggcctcccaaagtgctgggattataggagtgagccaccgcgcccggcctttttcttttctgcagagtttggaagcagaggtcttatggagtctcagttctgctaacaatctaaaagacttaacgctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataaggaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctat

SEQ ID NO: 164175 - DNA, 1440 bp, Homo sapiens
  Payload ID: 12325
  Gene Symbol: PTCD2
  Gene Name: pentatricopeptide repeat domain 2
  ENST ID: ENST00000503315
  CDS Start-End: 1-432
atggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttat

SEQ ID NO: 164176 - DNA, 1001 bp, Homo sapiens
  Payload ID: 12325
  Gene Symbol: PTCD2
  Gene Name: pentatricopeptide repeat domain 2
  ENST ID: ENST00000510676
  CDS Start-End: 391-1001
ccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccg

SEQ ID NO: 164177 - DNA, 1653 bp, Homo sapiens
  Payload ID: 12325
  Gene Symbol: PTCD2
  Gene Name: pentatricopeptide repeat domain 2
  Uniprot ID: Q8WV60
  ENST ID: ENST00000503868
  CDS Start-End: 8-847
agttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataaggaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagttt

SEQ ID NO: 164178 - DNA, 881 bp, Homo sapiens
  Payload ID: 12325
  Gene Symbol: PTCD2
  Gene Name: pentatricopeptide repeat domain 2
  ENST ID: ENST00000515198
  CDS Start-End: 16-501
gttccagtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtggtg

SEQ ID NO: 164179 - DNA, 569 bp, Homo sapiens
  Payload ID: 12325
  Gene Symbol: PTCD2
  Gene Name: pentatricopeptide repeat domain 2
  ENST ID: ENST00000511752
  CDS Start-End: 11-292
agtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctct

SEQ ID NO: 164180 - DNA, 2029 bp, Homo sapiens
  Payload ID: 12325
  Gene Symbol: PTCD2
  Gene Name: pentatricopeptide repeat domain 2
  ENST ID: ENST00000543322
  CDS Start-End: 508-1104
ggttccagtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataaggaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaatttt

SEQ ID NO: 164181 - DNA, 1911 bp, Homo sapiens
  Payload ID: 12325
  Gene Symbol: PTCD2
  Gene Name: pentatricopeptide repeat domain 2
  Uniprot ID: Q8WV60
  ENST ID: ENST00000536805
  CDS Start-End: 336-986
ggttccagtagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataaggaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaatttt

SEQ ID NO: 164182 - DNA, 6734 bp, Homo sapiens
  Payload ID: 12326
  Gene Symbol: PTCD3
  Gene Name: pentatricopeptide repeat domain 3
  Uniprot ID: Q96EY7
  ENST ID: ENST00000254630
  CDS Start-End: 67-2136
cactgcgccccaccttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatgggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagttgtccacataagcagcttcatctttaccttgccagagttgacaattatgggatactctagtctacttatacttgtgttcccatctgtctgccatcctctgaaggccgggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagagagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagttgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatacaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaaaaaaaaaaaaaaaccaaaaaaactgtccagctgtggactttcaggattcaggactgctggggatcaagcccaaggatgtttttcagagctctgtgatttaagatgctcgaaaagagtgtccaagaggagtaaaggtcatgacagaatttactcccaggacaatctaagttctgccacaagtacccgtggtgtctgttcccacaacaatggccctttcacaagctcttgcctcacaacccctgcagaagtccttcaacaaaactaataatagactagtgaaacctactcctcacatgggtaagagttgcagtgggcaggtgaccctcctccctgcccccatcctttgcttcctcaagctccctgccaacctctggatacatcaatgggaaggaaaccagggaagcatagacctatagtacaacaggggtgtagtgaccactggacctgatgaagcgaatctgcctgaaatttaatacgcctttttatttcccttctgtgttaaatcaaatgatctgttctgcactgagccaagcaagttacttttaaaactggtggcaccactcatttgggacttggagactgcttttatccagaacctgttaagagaacaggggatttaaatacaaaggaatatgaaggtggtgtgccttaaagacagtctaaaattaggttttagtttgttacattattttgaaatattaaacatgaaaatgttaaatcaggatgtgtgagttttaagatgttgaacactgtcctacatcagtgaggagggaggcaataaagtaatttcagagtaaaacagattgaggatgaaaccaagacagaagtgatgatttggctttttatgatttttgctgtggaaatggcagtcgtgtgacttttcacttgcagtttaaatgaaagggtgaagagaagcctacctgccctaatggctcagggctatatccacctcccggataaccctggcccttgggactccatcatctccttgaagtagcactgagaatccaagaagaggctccgctgctttttgcacatgttactgagttacatctcaggaagatttttaagcacgaggaaggaaaatacaggcctggccaagcagggtccccttttcggtatcatctttgttcctaataagcaatcaaggggggtgggtgtgttggctggtaaaggaactactaagattcagaagcttgtagtcttcattattttgttttacaggttaaaataaaccacttgactggg

SEQ ID NO: 164183 - DNA, 587 bp, Homo sapiens
  Payload ID: 12326
  Gene Symbol: PTCD3
  Gene Name: pentatricopeptide repeat domain 3
  ENST ID: ENST00000409783
  CDS Start-End: 25-587
acatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaa

SEQ ID NO: 164184 - DNA, 522 bp, Homo sapiens
  Payload ID: 12326
  Gene Symbol: PTCD3
  Gene Name: pentatricopeptide repeat domain 3
  ENST ID: ENST00000409326
  CDS Start-End: 26-262
aacatgctctgcagagaaatcaaagatggcggttgtatctgctgttcgctggctgggcctccgcagcaggcttggccagccgctgacgggtcggcgggcgggtttgtgtgaacaggcacgcagctgcagttcccctcaagaaagagaaaccactccatctgatactgcagaaacctttgtgctgccattcaatgccagtcctccgtttcctgattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccg

SEQ ID NO: 164185 - DNA, 532 bp, Homo sapiens
  Payload ID: 12326
  Gene Symbol: PTCD3
  Gene Name: pentatricopeptide repeat domain 3
  ENST ID: ENST00000418628
  CDS Start-End: 23-232
atgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgtgaccttgtgacataaccagcttcagatgagatctgcactatgttattggccagtacactgagagtagaatcacttgttcggtttgtggctatgaagagccctgatgaggattaacttgtggttcttatttttagggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcatacccc

SEQ ID NO: 164186 - DNA, 210 bp, Homo sapiens
  Payload ID: 12326
  Gene Symbol: PTCD3
  Gene Name: pentatricopeptide repeat domain 3
  ENST ID: ENST00000627371
  CDS Start-End: 1-210
atggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgtgaccttgtgacataa

SEQ ID NO: 164187 - DNA, 1940 bp, Homo sapiens
  Payload ID: 12327
  Gene Symbol: PTX3
  Gene Name: pentraxin 3, long
  Uniprot ID: P26022
  ENST ID: ENST00000295927
  CDS Start-End: 146-1291
tcattcatccccattcaggctttcctcagcatttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgcctgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaagatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactagctcacgtcatttaattataaatttaagagatgttttgga

SEQ ID NO: 164188 - DNA, 1422 bp, Homo sapiens
  Payload ID: 12328
  Gene Symbol: PTX4
  Gene Name: pentraxin 4, long
  Uniprot ID: Q96A99
  ENST ID: ENST00000293922
  CDS Start-End: 1-1422
atggggagtggaaactgggaggtcacaggtccaccttgtggcagtcggtgtgaacggcctcccggactcccacgcggggtccacggacagttccggagtgctgtgggcctgtcgggcctgcgctggttccggagattccaggaggtgacctggacacacctgcagaacatcgccagcaactacaacgtgtcctacaacgttgacgtccggttccggagcctggcggaagagagccaggctgtggctcaggcagtcaaccggtcacaggcctcggtgcagggggagctggcgcagctcaaggcctgggtgaggaagctgcagcgccgaggccggaaagtagacacgcggctgcgggccttggacctcaccctgggcgagaggagccagcagcgggcccgggaaaggaaggcacacaaggcccagagggacgccctgcaggactcactggcacgcctggagggcctcgtccacagccagggcgccaggctggctgctctggaggggcggctgcccgtggcccaccctggcactgcagccctcgggccggccctggtcccaaccccaacccagcctgaggagctgggcccgacctccctgaagcttcagagggacaggcaggagctccgagctgcctctgagcacaggggccccccacaggactcctcggcccctctccaagggaggcgggagcctccagcctcaggcagccatcgggtactcagtgggactgccccaaaagaccctcggcagcaggcatggtccccccaggtgccaggagagatttgcggcgtgggccccaccctcgttttcccaaacgcctccaccaggaacgtggtcttcctcagccctggtttcgtcactgccctgcgagccctgtccttctgcagctgggtccgcacggcctccggccgcctgggcaccctcctgtcctacgccaccgaggacaatgacaacaagctggtgctgcacggccgagactccctgctgcccggatccatccacttcgtgatcggggacccggccttcagggagctgcccttgcagctgctgctggacggccagtggcaccacatctgtgtcatctggacgtccacccagggcaggtactggctccacgtggatcgcaggctggtggccaccggctcccgcttcagggagggctatgagatcccccccggagggtccctcgtgctgggccaggaacaagacagcgtggggggcggattcgacagctccgaggccttcgtggggagcatgtctggcttggctatctgggatcgggcgctggttcccggggaagttgcaaaccttgccatcgggaaagagttcccgacaggtgccatcctgacgctggccaatgctgcactagcaggcggatttgtgcagggggccaactgcacctgcctggaacgctgtccctga

SEQ ID NO: 164189 - DNA, 1516 bp, Homo sapiens
  Payload ID: 12328
  Gene Symbol: PTX4
  Gene Name: pentraxin 4, long
  Uniprot ID: Q96A99
  ENST ID: ENST00000447419
  CDS Start-End: 27-1463
ctgctggggccttgccgtctctccggatgggttgctcgtggaggaagaccttgtctttcttccttgtttttgtgcctatatatctacatggggcttcatcgcaggaagccgccccagtggggcccaggaaaccgtttttcgagaggctccgtaggctggaggaacagttccggagattccaggaggtgacctggacacacctgcagaacatcgccagcaactacaacgtgtcctacaacgttgacgtccggttccggagcctggcggaagagagccaggctgtggctcaggcagtcaaccggtcacaggcctcggtgcagggggagctggcgcagctcaaggcctgggtgaggaagctgcagcgccgaggccggaaagtagacacgcggctgcgggccttggacctcaccctgggcgagaggagccagcagcgggcccgggaaaggaaggcacacaaggcccagagggacgccctgcaggactcactggcacgcctggagggcctcgtccacagccagggcgccaggctggctgctctggaggggcggctgcccgtggcccaccctggcactgcagccctcgggccggccctggtcccaaccccaacccagcctgaggagctgggcccgacctccctgaagcttcagagggacaggcaggagctccgagctgcctctgagcacaggggccccccacaggactcctcggcccctctccaagggaggcgggagcctccagcctcaggcagccatcgggtactcagtgggactgccccaaaagaccctcggcagcaggcatggtccccccaggtgccaggagagatttgcggcgtgggccccaccctcgttttcccaaacgcctccaccaggaacgtggtcttcctcagccctggtttcgtcactgccctgcgagccctgtccttctgcagctgggtccgcacggcctccggccgcctgggcaccctcctgtcctacgccaccgaggacaatgacaacaagctggtgctgcacggccgagactccctgctgcccggatccatccacttcgtgatcggggacccggccttcagggagctgcccttgcagctgctgctggacggccagtggcaccacatctgtgtcatctggacgtccacccagggcaggtactggctccacgtggatcgcaggctggtggccaccggctcccgcttcagggagggctatgagatcccccccggagggtccctcgtgctgggccaggaacaagacagcgtggggggcggattcgacagctccgaggccttcgtggggagcatgtctggcttggctatctgggatcgggcgctggttcccggggaagttgcaaaccttgccatcgggaaagagttcccgacaggtgccatcctgacgctggccaatgctgcactagcaggcggatttgtgcagggggccaactgcacctgcctggaacgctgtccctgaggccgagccgcacgggggctgaggccagcaagggcagcatgcccccatccaca

SEQ ID NO: 164190 - DNA, 1117 bp, Homo sapiens
  Payload ID: 12328
  Gene Symbol: PTX4
  Gene Name: pentraxin 4, long
  ENST ID: ENST00000440447
  CDS Start-End: 73-651
cagacccacggagccaccttcaccctctcctgcggctggagggagactgctggggccttgccgtctctccggatgggttgctcgtggaggaagaccttgtctttcttccttgtttttgtgcctatatatctacatggggcttcatcgcaggaagccgccccagtggggcccaggaaaccgtttttcgagaggctccgtaggctggaggaacagttccggagattccaggaggtgacctggacacacctgcagaacatcgccagcaactacaacgtgtcctacaacgttgacgtccggttccggagcctggcggaagagagccaggctgtggctcaggcagtcaaccggtcacaggcctcggtgcagggggagctggcgcagctcaaggcctgggtgaggaagctgcagcgccgaggccggaaatttgcggcgtgggccccaccctcgttttcccaaacgcctccaccaggaacgtggtcttcctcagccctggtttcgtcactgccctgcgagccctgtccttctgcagctgggtccgcacggcctccggccgcctgggcaccctcctgtcctacgccaccgaggacaatgacaacaagctggtgctgcacggccgagactccctgctgcccggatccatccacttcgtgatcggggacccggccttcagggagctgcccttgcagctgctgctggacggccagtggcaccacatctgtgtcatctggacgtccacccagggcaggtactggctccacgtggatcgcaggctggtggccaccggctcccgcttcagggagggctatgagatcccccccggagggtccctcgtgctgggccaggaacaagacagcgtggggggcggattcgacagctccgaggccttcgtggggagcatgtctggcttggctatctgggatcgggcgctggttcccggggaagttgcaaaccttgccatcgggaaagagttcccgacaggtgccatcctgacgctggccaatgctgcactagcaggcggatttgtgcagggggccaactgcacctgcctggaacgctgtccctgaggccgagccgcacgggggctgaggccagcaagggcagcatgcccccatccaca

SEQ ID NO: 164191 - DNA, 1748 bp, Homo sapiens
  Payload ID: 12329
  Gene Symbol: PGA3
  Gene Name: pepsinogen 3, group I (pepsinogen A)
  Uniprot ID: P0DJD8
  ENST ID: ENST00000325558
  CDS Start-End: 186-1352
tcagaatgtggcttagggcagccacaatcttatcaggagcttctctgtttgggatcaggggaaccggtgactttcagaggccgataaggcgggacccaacttgtatataaggggcagctcatgctgctgctctgcaccttcctcccgtcttgccttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacaccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcat

SEQ ID NO: 164192 - DNA, 867 bp, Homo sapiens
  Payload ID: 12329
  Gene Symbol: PGA3
  Gene Name: pepsinogen 3, group I (pepsinogen A)
  ENST ID: ENST00000538258
  CDS Start-End: 344-730
gtttttgttccctgcctcatgcctgactgatcatcttgcccttctgccaacataacttatcttgccagctaggcagggagctccctgcagcctggaactgtgaggctgtcttgtttcacttggcatttcccatgcctggcagagagtaggcacttgggaaatatttgttgggcaaatgaatgcgggacgaatgagtgcgtgaacgagaggaacagaaatttcacgcattggccaatggatgggtggggaagaaatgtctgggctcacctcctagttcctccttggagagaagtacccctgagagctcagggagcttaacttgcttcttgccctcagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacg

SEQ ID NO: 164193 - DNA, 968 bp, Homo sapiens
  Payload ID: 12329
  Gene Symbol: PGA3
  Gene Name: pepsinogen 3, group I (pepsinogen A)
  ENST ID: ENST00000543125
  CDS Start-End: 101-805
tcaacctaaaaggcctgtgttcttccaaacgtagttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccctgaggaggcaacagcagatggtcacacaaatggacgaacaaaaaaattcatgtcttctcccctcactttccacagcgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaa

SEQ ID NO: 164194 - DNA, 608 bp, Homo sapiens
  Payload ID: 12329
  Gene Symbol: PGA3
  Gene Name: pepsinogen 3, group I (pepsinogen A)
  ENST ID: ENST00000543349
  CDS Start-End: 55-608
cagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacag

SEQ ID NO: 164195 - DNA, 1627 bp, Homo sapiens
  Payload ID: 12329
  Gene Symbol: PGA3
  Gene Name: pepsinogen 3, group I (pepsinogen A)
  ENST ID: ENST00000543505
  CDS Start-End: 831-1627
acagcaagcagaccagtgtggcgggaacagagccggcagggggaaaatgctgccactaacaagaaaaatactggttgattggcggaggcgggtggatcacttgaggtcaggagttcgagaccagcccggcaacatggtgaaaccccgtctctactaaaaatacaaaaatttgccgggcatgatggcacacacctgtaatctcagctacttgggaggttgaggcaggagaatcactggaacccaggaggaggaggctgcagtgagccgaggtcgcgccactgcactcccgcctggacaacagagtgagacttgtctcaaaaaaaaagaataaaaattctggcaatgccctttctcaaaacctgctgtacacatctagacgtagaaataagaaaactggacaggtttccatctttaagtggcttgcttagcttctgataaacaatttaaggcacaagcacttaagctgtaacttgcccggtgctagaaggttccaccgccatcctctgagaacatgcgctgtacggatgggaagactgtgacagacaagacaatggctaaagagggaacagcagattgttaggtgcttgtggtgcttaacagagagcagagggtaaattgggggagcaatcagggaagacttcaaggaggaagggacgccagggctgggatttgaaggatgaagacagtggctgggaagagaaagataagaactgtgaggaatgaaggaaaagatggagaggcagactgaggagatgacccagagacagcccctagggaggccctgacagagagaccccgttccgtgaactgccctgtcctcgcctggacagatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgca

SEQ ID NO: 164196 - DNA, 1748 bp, Homo sapiens
  Payload ID: 12330
  Gene Symbol: PGA4
  Gene Name: pepsinogen 4, group I (pepsinogen A)
  Uniprot ID: P0DJD7
  ENST ID: ENST00000378149
  CDS Start-End: 186-1352
tcagaatgtggctcagggcagccacaatcttatcaggagcttctctgtttgggatcaggggaaccggtgactttcagaggccgataaggcgggacccaacttgtatataaggggcagctcatgctgctgctctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcat

SEQ ID NO: 164197 - DNA, 840 bp, Homo sapiens
  Payload ID: 12330
  Gene Symbol: PGA4
  Gene Name: pepsinogen 4, group I (pepsinogen A)
  ENST ID: ENST00000537932
  CDS Start-End: 101-805
tcaacctaaaaggcctgtgttcttccaaacgtagttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccctgaggaggcaacagcagatggtcacacaaatggacgaacaaaaaaattcatgtcttctcccctcactttccacagcgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatct

SEQ ID NO: 164198 - DNA, 867 bp, Homo sapiens; identical to SEQ ID NO: 164192
  Payload ID: 12330
  Gene Symbol: PGA4
  Gene Name: pepsinogen 4, group I (pepsinogen A)
  ENST ID: ENST00000544899
  CDS Start-End: 344-730

SEQ ID NO: 164199 - DNA, 1519 bp, Homo sapiens
  Payload ID: 12331
  Gene Symbol: PGA5
  Gene Name: pepsinogen 5, group I (pepsinogen A)
  Uniprot ID: P0DJD9
  ENST ID: ENST00000312403
  CDS Start-End: 186-1352
tcagaatgtggctcagggcagccacaatcttatcaggagcttctctgtttgggatcaggggaaccggtgactttcagaggccgataaggcgggacccaacttgtatataaggggcagctcatgctgctgctctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaagcctaagtctcttcagccacctcccaggaagatctggcctccgtcctatgcccactttagatgtatctaattctcctgactgttcttcccaggggagtgtgaaggtcttggccctgttccctgtcctaccaataacgtagaataaaaacataacccactgaaacagg

SEQ ID NO: 164200 - DNA, 971 bp, Homo sapiens
  Payload ID: 12331
  Gene Symbol: PGA5
  Gene Name: pepsinogen 5, group I (pepsinogen A)
  ENST ID: ENST00000451616
  CDS Start-End: 104-808
cattcaaactataaggcctgtgttcttccaaacgtagttccaccactcccccgctgtgtgaccttgggcaggtggcctcacctccctcaggctcagtgtcctcatggtaagtggaaacaacagtgacggtgcccactgcatgggccctggcctaagaggaaaagaaaccacattggtcacaccccaggacagccctggaaagtgcccaatcaacggtcgctctgaggaggcaacagcagatggtcacacaaatggacgaacaaaaaaattcatgtcttctcccctcactttccacagcgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaagcctaagtctcttcagccacctcccaggaagatctggcctccgtcctatgcccactttagatgtatctaattctcctgactgttcttcccaggggagtgtgaaggtcttggccctgttccctgtcctaccaataacgtagaataaaaacataacccactgaaa

SEQ ID NO: 164201 - DNA, 867 bp, Homo sapiens
  Payload ID: 12331
  Gene Symbol: PGA5
  Gene Name: pepsinogen 5, group I (pepsinogen A)
  ENST ID: ENST00000541528
  CDS Start-End: 344-730
gtttttgttccctgcctcatgcctgactgatcatcttgcccttctgccaacataacttatcttgccagctaggccgggagctccctgcagcctggaactgtgaggctgtcttgtttcgcttggcgtttcccatgcctggcagagggtaggcacttgggaaatatttgtagggtaaatgaatgcgggatgaatgagtgcgtgaacgagaggaacagaaatttcacgcattggccaatggatgggtggggaaggaatgtctgggctcacctcctggttcctccttggagagatgaacccctgagggctcagggagcttaacttgcttcttaccctcagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaagcctaagtctcttcagccacctcccaggaagatctggcctccgtcctatgcccactttagatgtatctaattctcctgactgttcttcccaggggagtgtgaaggtcttggccctgttccctgtcctaccaataacg

SEQ ID NO: 164202 - DNA, 2174 bp, Homo sapiens
  Payload ID: 12332
  Gene Symbol: PMPCA
  Gene Name: peptidase (mitochondrial processing) alpha
  Uniprot ID: Q10713
  ENST ID: ENST00000371717
  CDS Start-End: 100-1677
ccgaaagcgcgtgcctgaacgccttgggccgtcggcgagggggaggggaagccgtgggcggaagcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttctta

SEQ ID NO: 164203 - DNA, 2316 bp, Homo sapiens
  Payload ID: 12332
  Gene Symbol: PMPCA
  Gene Name: peptidase (mitochondrial processing) alpha
  ENST ID: ENST00000444897
  CDS Start-End: 1-816
tacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgtgagtaccgcaggggtagtgaggggctgccgcaggcctcggccaggctcagaggaggccgtctcgccctcccgcaggccgtggtgggcctgtggtatgtccatcacacccagaatctggggccttcaccagttgtcctcagcaggggcggccaagggcagggtcgtggggtcgcagacctggtctcacttcccggccccaccatgcacctgctgcctccttggcaggtgaccccaccctctgcacccctgggaggggctgtcactactgcccagagttgttaaagagcactcaagttagtaggcgagaagggctcagtagaggactgctacattgtacgtggagtagcagtggctcggaatgccgctgtaccgttgctggctctcgggcaggagtctcagccccaggtttccggggcccccatgagtgaccttaggaggtctgaatttcctgaaactgccaagttgtatgtgcatcggactcttctgggggacaggcttaaaacctggcaaggctgcctattacgttggggtggctcgggcttatggtgtcacctgtgggcatctcctttccaggcctggagtcccgggcacttgccctgtcccgtgtgggccctcgtccttccctcaggagcccccgcttaaatcctcaagcgagtgtccagcctctctcgggcctcgttttctgtagaaaacagacccacctggaccctatcactcctgtcctggggttcctgggtgcagccctttggccttctctcaccccacccttctgtccatgcggccctcgggggctgggggttttttctgcaggccgtcctaaagtgagttcatcagacacggagctcgctcttctgtaagtgtaactcttcttgggtggctttgtcctatatttttaagtcattgccatgtccccatttactgagaactcaacgtctgtcacttgtggactcacccttggctacacccagtggctgcctttgggcccaggtgcccccatcagcagcacagcgtgagtgagtggtacagaccagccgccccctccgtgtgtttactgatgcagcctcagcgtgggggccgtggcgcgctcgtgtgacacgcgtttgccctctgcactaggcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttctt

SEQ ID NO: 164204 - DNA, 1987 bp, Homo sapiens
  Payload ID: 12332
  Gene Symbol: PMPCA
  Gene Name: peptidase (mitochondrial processing) alpha
  Uniprot ID: Q10713
  ENST ID: ENST00000399219
  CDS Start-End: 307-1491
gacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttctt

SEQ ID NO: 164205 - DNA, 2472 bp, Homo sapiens
  Payload ID: 12333
  Gene Symbol: PMPCB
  Gene Name: peptidase (mitochondrial processing) beta
  Uniprot ID: O75439
  ENST ID: ENST00000249269
  CDS Start-End: 39-1508
aagcacatccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatga

SEQ ID NO: 164206 - DNA, 2385 bp, Homo sapiens
  Payload ID: 12333
  Gene Symbol: PMPCB
  Gene Name: peptidase (mitochondrial processing) beta
  ENST ID: ENST00000444457
  CDS Start-End: 5-373
agaaatggcggctgcggcggctcgagtggtgttgtcatccgcggcgcggcggcggctctggggtttcagcgagagtcttctaatccgaggcgctgcgggacgggtgagcttccctccaggccggtcctgtcctcgagatctcgccagacccggcgcagcgcacctgagagtcggcgccacagatccgaacagtgggtcgggcagggcctcctcgacccggacccgccgggcgccaggcggcctggggctgctgaactggccgggggtgactggcttgtggccacccgccaggagacctgctagtgacgtgtgggatgaccctggttttcggctcctcccgccagctactgaggagtgcatgtttgaccactaaaaacgtagtgcttgcaaattggggaaaactaaaaagtgaaatgggtaccgctccagagttctatttttgcctaagactgaacttcgtcctcagctgggcttcccgcgaacctggacatcaatgaatcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggatataatcacagaagtgaacttcatgaatggaaatggaacaagttattttccaaaaggcaaactatttcatactcctacgtgaacatccttttaccacagcctcagccacagtacgtctaattatttaaaatttgtgattatcgctggtggtcaacaatttttttgtttttcatcctttaactggaaaaaggaggggctgtctcagtttttcttctgactctgtgtgtcacttacaattaataatgctagctgttaacatctacatagcagttgacatgtgccaggcctgtttaccagttaatcttctccatgatcctatgaggaaagtgctattgctgtctccatttcatagatgaggaaaatgaggcacagaggagacgttatgtagccactaccactgcaacttgctcaaacttccggccaagtcggctctagtccagacagcctgactcctcagcctgcgtctgtatgctgcctctcctaattcattatgtttattaataatttttccccgttttgttaacacttatgtttcaaaaacagtcatctttatttacattgactgatcatttcttttgt

SEQ ID NO: 164207 - DNA, 1714 bp, Homo sapiens
  Payload ID: 12333
  Gene Symbol: PMPCB
  Gene Name: peptidase (mitochondrial processing) beta
  ENST ID: ENST00000428154
  CDS Start-End: 26-1498
atcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaa

SEQ ID NO: 164208 - DNA, 904 bp, Homo sapiens
  Payload ID: 12333
  Gene Symbol: PMPCB
  Gene Name: peptidase (mitochondrial processing) beta
  ENST ID: ENST00000456433
  CDS Start-End: 8-616
agcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagcttatcaaaatactgcacttggacggacaattttgggaccaactgaaaatatcaaatctataagtcgtaaggacttagtggattatataaccacacattataaggggccaagaatagtgcttgctgctgctggagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatg

SEQ ID NO: 164209 - DNA, 1323 bp, Homo sapiens
  Payload ID: 12333
  Gene Symbol: PMPCB
  Gene Name: peptidase (mitochondrial processing) beta
  ENST ID: ENST00000443722
  CDS Start-End: 7-375
gcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaaggcaaggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttga

SEQ ID NO: 164210 - DNA, 1509 bp, Homo sapiens
  Payload ID: 12333
  Gene Symbol: PMPCB
  Gene Name: peptidase (mitochondrial processing) beta
  ENST ID: ENST00000453466
  CDS Start-End: 4-363
gaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaaggcaaaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataa

SEQ ID NO: 164211 - DNA, 1910 bp, Homo sapiens
  Payload ID: 12334
  Gene Symbol: PEPD
  Gene Name: peptidase D
  Uniprot ID: P12955
  ENST ID: ENST00000244137
  CDS Start-End: 35-1516
gccgcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtc

SEQ ID NO: 164212 - DNA, 1754 bp, Homo sapiens
  Payload ID: 12334
  Gene Symbol: PEPD
  Gene Name: peptidase D
  Uniprot ID: P12955
  ENST ID: ENST00000397032
  CDS Start-End: 32-1390
gcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggc

SEQ ID NO: 164213 - DNA, 1638 bp, Homo sapiens
  Payload ID: 12334
  Gene Symbol: PEPD
  Gene Name: peptidase D
  Uniprot ID: P12955
  ENST ID: ENST00000436370
  CDS Start-End: 29-1318
cttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaaga

SEQ ID NO: 164214 - DNA, 581 bp, Homo sapiens
  Payload ID: 12334
  Gene Symbol: PEPD
  Gene Name: peptidase D
  ENST ID: ENST00000588328
  CDS Start-End: 1-581
agtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgccaggacggggaggactgtcttcagtgtgggcaccatgtccacccctcctgccggccgcaatggtgtctggtggcctgacatgcaccgcctggctgaccgcatccacctggaggagctgg

SEQ ID NO: 164215 - DNA, 570 bp, Homo sapiens
  Payload ID: 12334
  Gene Symbol: PEPD
  Gene Name: peptidase D
  ENST ID: ENST00000609145
  CDS Start-End: 258-570
gtcattatgaaggaatggtggcatgtcatcttcattaggcttagtggtgcctctaaagtgggtttttctttccgaccttctagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccg

SEQ ID NO: 164216 - DNA, 547 bp, Homo sapiens
  Payload ID: 12334
  Gene Symbol: PEPD
  Gene Name: peptidase D
  ENST ID: ENST00000590755
  CDS Start-End: 1-168
attgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgctgggagctctgactcgcctcgtcttagagcttgggaccaaggaggtatcctgaaagatgaatgggcatcggctgtggaaaaagaaggagtaggagagagtgaccctggcaaaaggaccactcgttcacagaaacaagagaaagggtggtggctctgtgtggccagtgcggagccagggagcagagcccgagaacagttggagagacaggcagtggctggccgagtgtttaagacggatatggagctggaggttctgcgctataccaataaaatctccagcgaggcccaccgtgaggtaatgaaggctgtaaaagtgggaatgaaagaatatgagttggaaaggtaagccaccatgtttctccgggtaaaattaaaaggtaaaaaacagtaa

SEQ ID NO: 164217 - DNA, 433 bp, Homo sapiens
  Payload ID: 12334
  Gene Symbol: PEPD
  Gene Name: peptidase D
  ENST ID: ENST00000590408
  CDS Start-End: 1-127
ggcgttcggtgtcactgagccaggctgctatggtgtcatcgatgttgacactgggaagtcgaccctgtttgtgcccaggcttcctgccagccatgccacctggatgggaaaattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaaggtaagccaccatgtttctccgggtaaaattaaaaggtaaaaaac

SEQ ID NO: 164218 - DNA, 2402 bp, Homo sapiens
  Payload ID: 12335
  Gene Symbol: PAMR1
  Gene Name: peptidase domain containing associated with muscle regeneration 1
  ENST ID: ENST00000527605
  CDS Start-End: 378-2402
agatgaggatgggagagcctggcgagctgaaacccgagctcccgctcagctggggctcggggaggtccctgtaaaacccgcctgcccccggcctccctgggtccctcctctccctccccagtagacgctcgggcaccagccgcggcaaggatggagctgggttgctggacgcagttggggctcacttttcttcagctccttctcatctcgtccttgccaagagaatgatgaacgacatacctgagagccagaccagcatgatggttaatgctctctgactctggaaacagcctacttggatttgaatcctgtctctgctacttactacttagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatcttctggaggctgggaagtccaagatcaaggcgtcagaagattcattgtctgtccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagc

SEQ ID NO: 164219 - DNA, 551 bp, Homo sapiens
  Payload ID: 12335
  Gene Symbol: PAMR1
  Gene Name: peptidase domain containing associated with muscle regeneration 1
  ENST ID: ENST00000529303
  CDS Start-End: 19-551
gcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgccatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgg

SEQ ID NO: 164220 - DNA, 2613 bp, Homo sapiens
  Payload ID: 12335
  Gene Symbol: PAMR1
  Gene Name: peptidase domain containing associated with muscle regeneration 1
  ENST ID: ENST00000611014
  CDS Start-End: 840-2090
agagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaact

SEQ ID NO: 164221 - DNA, 2801 bp, Homo sapiens
  Payload ID: 12335
  Gene Symbol: PAMR1
  Gene Name: peptidase domain containing associated with muscle regeneration 1
  Uniprot ID: Q6UXH9
  ENST ID: ENST00000615849
  CDS Start-End: 447-2276
agggcaaagccagctcccgtctcagcctcccgtaggaagatctcccggcctcacctgagcgccccgcagccctgggtacctctgctcccgcccagggtcctatggcccctcctcccagcacccaacactgggaccccacctgtacccaggctggcctccctcccccgcagcttcctttgcagccgccgtccgcgggtctccaggcgtggccacacctcccggggccccgcaagggttaaggcagcagagaggagaggtttgggctgacgtcgctctggctgaaggtggttcccctcagatgaggatgggagagcctggcgagctgaaacccgagctcccgctcagctggggctcggggaggtccctgtaaaacccgcctgcccccggcctccctgggtccctcctctccctccccagtagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgccatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactac

SEQ ID NO: 164222 - DNA, 2842 bp, Homo sapiens
  Payload ID: 12335
  Gene Symbol: PAMR1
  Gene Name: peptidase domain containing associated with muscle regeneration 1
  ENST ID: ENST00000621476
  CDS Start-End: 557-2599
ttcattagggctggagacttccatgaaggggccagttacagcaggctccagtggaagggccctttgtcttttccacaatcctgcccttctccatctctggccttggctgacttgaacttggtgttttgcacagctgatggaaaccaaacttaattaccagaagtctgggatgcctcttataggtttgcagaccagttctacctctggcctgtttcctctggctttcccagtgtgtggttgctgcttagctgctgatctgcagaagtgatagctgggagatagagggaactgtaagaattcacaaagacagtctcctctgctgtttctccctgtggattcacatgcaaccagcctccctggtggcactgaaaaagccctgggattattgtgcagttcaacaagaatgatgaacgacatacctgagagccagaccagcatgatggttaatgctctctgactctggaaacagcctacttggatttgaatcctgtctctgctacttactacttagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttctt

SEQ ID NO: 164223 - DNA, 2785 bp, Homo sapiens
  Payload ID: 12335
  Gene Symbol: PAMR1
  Gene Name: peptidase domain containing associated with muscle regeneration 1
  Uniprot ID: Q6UXH9
  ENST ID: ENST00000622144
  CDS Start-End: 39-2252
cctccccagtagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatcttctggaggctgggaagtccaagatcaaggcgtcagaagattcattgtctgtccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaacaaa

SEQ ID NO: 164224 - DNA, 3142 bp, Homo sapiens
  Payload ID: 12335
  Gene Symbol: PAMR1
  Gene Name: peptidase domain containing associated with muscle regeneration 1
  Uniprot ID: Q6UXH9
  ENST ID: ENST00000619888
  CDS Start-End: 447-2609
agggcaaagccagctcccgtctcagcctcccgtaggaagatctcccggcctcacctgagcgccccgcagccctgggtacctctgctcccgcccagggtcctatggcccctcctcccagcacccaacactgggaccccacctgtacccaggctggcctccctcccccgcagcttcctttgcagccgccgtccgcgggtctccaggcgtggccacacctcccggggccccgcaagggttaaggcagcagagaggagaggtttgggctgacgtcgctctggctgaaggtggttcccctcagatgaggatgggagagcctggcgagctgaaacccgagctcccgctcagctggggctcggggaggtccctgtaaaacccgcctgcccccggcctccctgggtccctcctctccctccccagtagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaacaaa

SEQ ID NO: 164225 - DNA, 6732 bp, Homo sapiens
  Payload ID: 12336
  Gene Symbol: PI15
  Gene Name: peptidase inhibitor 15
  Uniprot ID: O43692
  ENST ID: ENST00000260113
  CDS Start-End: 180-956
agcattcaaaccttgcagagctttgctctcagagagtttgtaaaaagacacactcctcttacaagagttcatgctaccacatagcaaagaaccttaaatttttggaagaacaatatattcattttggcattgtgcagagcaaagtaaactcggtggcctcttcttctccacccctcaaaatgatagcaatctctgccgtcagcagtgcactcctgttctcccttctctgtgaagcaagtaccgtcgtcctactcaattccactgactcatccccgccaaccaataatttcactgatattgaagcagctctgaaagcacaattagattcagcggatatccccaaagccaggcggaagcgctacatttcgcagaatgacatgatcgccattcttgattatcataatcaagttcggggcaaagtgttcccaccggcagcaaatatggaatatatggtttgggatgaaaatcttgcaaaatcggcagaggcttgggcggctacttgcatttgggaccatggaccttcttacttactgagatttttgggccaaaatctatctgtacgcactggaagatatcgctctattctccagttggtcaagccatggtatgatgaagtgaaagattatgcttttccatatccccaggattgcaaccccagatgtcctatgagatgttttggtcccatgtgcacacattatacgcagatggtttgggccacttccaatcggataggatgcgcaattcatacttgccaaaacatgaatgtttggggatctgtgtggcgacgtgcagtttacttggtatgcaactatgccccaaagggcaattggattggagaagcaccatataaagtaggggtaccatgttcatcttgtcctccaagttatgggggatcttgtactgacaatctgtgttttccaggagttacgtcaaactacctgtactggtttaaataagtttaccttttcctccaggaaatataatgatttctgggaacatgggcatgtatatatatatatggagagagaattttgcacatattatacatattttgtgctaatcttgttttcctcttagtattcctttgtataaattagtgtttgtctagcatgtttgtttaatcctttgaaatatttgaaacatcaatttctattttctgacctctaagcctaaattaagatattgtatatgtaatgatgacatagttgatgcatccaatcctaaaacttacattccaaaggaattatatcattatgttcctaaggagtaaatatatatttgacctgtaagtgtgtgtatgtatacatatacatatgtatgtgtatggatttatatatgcacacaaacatataatatgtgatgtaacatgtagatgataatatgattcagtagtcaacttgagggaaatttttaaaaaactattctcaattatatacgaggtgatgggacttcttaacacacatttctataatacccatgaaatgataatttgtaaaataacacttagtgatatctggaaataataattcaattaagcaaccacgaatttcaccctggagatattttttcttatttgagtccaccaaaggataatgccaacttatataagttctcaaatcatgccttccgcttagtctcattttattcattcagtcgtcatgagttgagtgcttactacatgcaaggcactctgctagttatattctaataatgcagagataattagacatggttcccgccctcaagaagctcacaaaagtattcaggaaataatgcagactagtgattttgctataaaattatttttgaaggaagcagacacagcagtatttacctgtaggtggagcaagtaataagccatgctgtgcaatatatacataaagcttctgcttctcatgggaatttagttacagtgcttggaatgagaaggggaaggaaagaattaacaaatgccaagatttctggagcagattgtacagctgtgactttggaaaacagaaagtaagaccctcagaaaaccaatgaagtctaagagaaataaaatttagtggacaggtatgaaaagtgtaattgcgcctaactaccagatggagagcttcagaatgggctatccttagagtctagtacatcttgaggcctctcagcaggagacaaaggattccaaaaagagatgtggaggtgctgagggcacctctatctctttgttgtttagtctgtcattgaatcaatctacttatcatcttgggtctttgagtattgtatgaaagatccttcgtgcacaccacacacagtcatgattttgttaaagtagccttcttcagatgcttttctaagggctagttaccaactttatttctgtgtttctgtagaagaaacattttcagttcttcattgagtttgattatggaaatccattcaaagtcactatgaaaattttactcatgtagtttggaaatgcaacattttcctatcatgaaatctctttcagagaggagaatacaacatcttagtccagacatttaacatactgcatttcaagtacatgtgtgtgtgttttattcaggttgtgtaatgctcccgtagaattatagaacaattaaatatggttagttccagagtgcaaattacagaaggaagctacttgtttaaaattccatacacgtttgcagtttcttgtacacatttggatactttgaaagatgacagattgttaaatccattcaatggtaaagaaactcaccatctggagattgagtctacttgttaatgaatgactagcccaattatccttataaattgaatatggtgaccaaatgctttgatatcatactactctgcctttgtgggcacatatgtagacactactaaaaataaatatttttggagattaaaatggagaatagaagtaattacattatttaggtcttaatccaacttttttctaatatatctaaacaattgaaagggaagcttattcatggaatattggcttgatttatctagaaagtttttccttcttcaattttactatattcattctacaggaacagcaataagtactattaaacagaagatggctacactaagttccaattttgttgctgaattgcttctgtgagttcacttttcagttctaaggaagaataatatttgctacatatttcacaggggttcttatgaaggtaaatttaccagattaataaaaatttatgaatattaaaattatcattaataatataaaacacttatttgagattaaattaaatttttcatgagcccctctttggcaggaactctgtttaattctttgtatttatcccagcttcttaaatggtggctgtaacataataaatgtttaataaatgcttatatgaatggatttttagaattaactaagaagccaaaaatggcaacaatttacagaaatcccacctttccatgcttaagacaaaaatgtcttaaatataaagctgtgattatatcaaaaatccagataaatcatcaaatatatcagattaagaccagggtttacacacttaggcaatagtcctttccaaaccatgacaaaaactacaagtttatttataatttaacaactcagctgaaaatataacgggtatatttgttattctaactctattttttaaagttaataatataaagtggccatgtaaaatattttattttccaggctaaagcaaatgaaagtttgctggtatcaacacagcctgccatatttttcacagcatgcaacaatggtgctaggatagctatttcttactgtaattgccagaggcagaaatggtctgggtataagctatttcataaaagcagctttaaattgtcagtattaaggttttcatgtggaaaggtgtcattcaaaaaaaaagtaattggcatacatattccacatcatcgatcctctctgtggtgttaatttttttatatgaccagtagaaaaattttaatattctcacaatataggttttggggcttccatatcatcaaaagactgaaaaattataattttagaattaaactgatggatttcattatagaattatctgtgagttgtgtagacacagtcttaatgtttctggttatgacagataagtttgctcaaaaaatgtggatgaagccattattgttattattgttattgcttctgttcagttgtctaagtatcatcccttctgtggcccatcacgcagcagagttgccctacaaatttcatttggcagcgccataacattcatttaaaaagtttatgaaaacattcatttgaaagttccatgcagctttagcacagagttgaccaaacactggcgtaagttcaatttacacagaatatttgaattgaaacaatagaaatttttctcataatatatacctatgtgaaaccaacttatctgcataattaaatctaatacatatttaagccagtttaagtgctttgtgttgatgccatgcttatcaaatacatgcacaagctaaacataatttgaatgggtctatgaaggaaaaataatgcttagactttggtgtaggttcttcctgtgtagccatatacccaggctctgcagtatcgaaggatgcaaatgttgacatagatggaagctcttacctaccaaagtgtttaggaaggataaagttacatttgtcttaatttctaacattatctttgcttttatgtttcataaaaatttgtcattatttatgctggtgaaacgtataatcacatccaattatttgaacacatgcaaaataattttttaaattatgttattgtttaaatttgacttatgggagatcagtcaaaaacttagaaggtttaacacttcactgattaatggtgctgaaaacacgttacaattaccacatatccttgctataagttttgaagtttcttagcaattaaagtttttttattcagtgtgaactgtcagtatctattctggtgctaaatgtatggtgctaaatgaattgttagtgttgatggctttagtaatgctccttttattcattgctaaatttagtgttatccatttgattcctgattcagaaatatcaataaaatcctatgttaaattaatctttaccaaaaacaggcaagttaactctgttgttttaattcaacagtccaacattatttaggtgttacagagtgtaaatatatttctttgggagttattttctttttaaaatctttttatagcttggcaatgtccaaagtcaaatatcacctaaactggttagattacttctacagctaataatattgcaggcactggcgccctctggtggttatgaagacaaattcttaatggctacttgacctacagcaaaagccatttctgtaccataaaaatttgttgtgcaatattagaattatcatatgtttcctacatctgacagcacctaaaatgtttgataatattaacatgtatctaagaggaaaaaagagttaatatattctggcacccactttcctagtaatgttttccatgattttccagttctgaggcacttattaaagtgcttttttttttctgaattaattaggtattggtaaaatatatttttaaatttagttagctttataaacacaattagaattacaattaattaacagaggtataattgtctcactttcagaagtgatcatttatttttatttagcacaggtcataagaaaaatatatagaaaaataatcaatttcatatataaaaggattatttctccacctttaattattggcctatcatttgttagtgttatttggtcatattattgaactaatgtattattccattcaaagtctttctagatttaaaaatgtatgcaaaagcttaggattatatcatgtgtaactattatagataacatcctaaaccttcagtttagatatataattgactgggtgtaatctcttttgtaatctgttttgacagatttcttaaattatgttagcataatcaaggaagatttaccttgaagcactttccaaattgatactttcaaacttattttaaagcagtagaaccttttctatgaactaaatcacatgcaaaactccaacctgtagtatacataaaatggacttacttattcctctcaccttctccagtgcctaggaatattcttctctgagccctaggattgattctatcacacagagcaacattaatctaaatggtttagctccctcttttttctctaaaaacaatcagctaataaaaaaaaaatttgagggcctaaattatttcaatggttgtttgaaatattcagttcagtttgtacctgttagcagtctttcagtttgggggagaattaaatactgtgctaagctggtgcttggatacatattacagcatcttgtgttttatttgacaaacagaattttggtgccataatattttgagaattagagaagattgtgatgcatatatataaacactatttttaaaaaatatctaaatatgtctcacatatttatataatcctcaaatatactgtaccattttagatattttttaaacagattaatttggagaagttttattcattacctaattctgtggcaaaaatggtgcctctgatgttgtgatatagtattgtcagtgtgtacatatataaaacctgtgtaaacctctgtccttatgaaccataacaaatgtagctttttaaagtccattgtattgttttttctttcaataaaagagtataattaa

SEQ ID NO: 164226 - DNA, 1413 bp, Homo sapiens
  Payload ID: 12336
  Gene Symbol: PI15
  Gene Name: peptidase inhibitor 15
  Uniprot ID: O43692
  ENST ID: ENST00000523773
  CDS Start-End: 465-1241
tcacttggtgtgtctatatgtctggcagacattatcagcacattctctgttgttacctgtgattcattttttcttcactctccaggtgaatttcaattgctgaaaatttcccactgaaaatatgcagtaatatattttgtggttcagacatttggggcaaatggttcacattcattttagggttagtggtcatgctgtttatttttctctgctatacaaagttcctcttaggggtctgcctcatgacactaaaaaatgaatagagattctactgtaggttatctcctaggcttgagttcaacatttgtttggatttttgaagaaagtcaaatcaagcaatgctcccaaatgatgtctttgtaaattcataccctctggccctattttttttcatagaccctaactctacctttctgctttaaagcaaagtaaactcggtggcctcttcttctccacccctcaaaatgatagcaatctctgccgtcagcagtgcactcctgttctcccttctctgtgaagcaagtaccgtcgtcctactcaattccactgactcatccccgccaaccaataatttcactgatattgaagcagctctgaaagcacaattagattcagcggatatccccaaagccaggcggaagcgctacatttcgcagaatgacatgatcgccattcttgattatcataatcaagttcggggcaaagtgttcccaccggcagcaaatatggaatatatggtttgggatgaaaatcttgcaaaatcggcagaggcttgggcggctacttgcatttgggaccatggaccttcttacttactgagatttttgggccaaaatctatctgtacgcactggaagatatcgctctattctccagttggtcaagccatggtatgatgaagtgaaagattatgcttttccatatccccaggattgcaaccccagatgtcctatgagatgttttggtcccatgtgcacacattatacgcagatggtttgggccacttccaatcggataggatgcgcaattcatacttgccaaaacatgaatgtttggggatctgtgtggcgacgtgcagtttacttggtatgcaactatgccccaaagggcaattggattggagaagcaccatataaagtaggggtaccatgttcatcttgtcctccaagttatgggggatcttgtactgacaatctgtgttttccaggagttacgtcaaactacctgtactggtttaaataagtttaccttttcctccaggaaatataatgatttctgggaacatgggcatgtatatatatatatggagagagaattttgcacatattatacatattttgtgctaatcttgttttcctcttagtattcctttgtataaattagtgtttgtctagcatgtttgtttaatcctttg

SEQ ID NO: 164227 - DNA, 2190 bp, Homo sapiens
  Payload ID: 12337
  Gene Symbol: PI16
  Gene Name: peptidase inhibitor 16
  Uniprot ID: Q6UXB8
  ENST ID: ENST00000373674
  CDS Start-End: 329-1720
cctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgtggcaa

SEQ ID NO: 164228 - DNA, 2083 bp, Homo sapiens
  Payload ID: 12337
  Gene Symbol: PI16
  Gene Name: peptidase inhibitor 16
  Uniprot ID: Q6UXB8
  ENST ID: ENST00000611814
  CDS Start-End: 224-1615
gctattgaaggggcatgactggaggcagaggccacagagatgaccacaccagggcaacctgtagtgccagtgcctggttccacccggggggcatctgagaactgtgtccttccattcctgagtccagcacttcccaggccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgtggc

SEQ ID NO: 164229 - DNA, 577 bp, Homo sapiens
  Payload ID: 12338
  Gene Symbol: PI3
  Gene Name: peptidase inhibitor 3, skin-derived
  Uniprot ID: P19957
  ENST ID: ENST00000243924
  CDS Start-End: 48-401
aaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 164230 - DNA, 2152 bp, Homo sapiens
  Payload ID: 12339
  Gene Symbol: PM20D1
  Gene Name: peptidase M20 domain containing 1
  Uniprot ID: Q6GTS8
  ENST ID: ENST00000367136
  CDS Start-End: 46-1554
gtcagaactaccccggtagcctgacagcaggagctcgagagaagcatggctcagcggtgcgtttgcgtgctggccctggtggctatgctgctcctagttttccctaccgtctccagatcgatgggcccgaggagcggggagcatcaaagggcgtcgcgaatcccttctcagttcagcaaagaggaacgcgtcgcgatgaaagaggcgctgaaaggtgccatccagattccaacagtgacttttagctctgagaagtccaatactacagccctggctgagttcggaaaatacattcataaagtctttcctacagtggtcagcaccagctttatccagcatgaagtcgtggaagagtatagccacctgttcactatccaaggctcggaccccagcttgcagccctacctgctgatggctcactttgatgtggtgcctgcccctgaagaaggctgggaggtgcccccattctctgggttggagcgtgatggcatcatctatggtcggggcacactggacgacaagaactctgtgatggcattactgcaggccttggagctcctgctgatcaggaagtacatcccccgaagatctttcttcatttctctgggccatgatgaggagtcatcagggacaggggctcagaggatctcagccctgctacagtcaaggggcgtccagctagccttcattgtggacgaggggggcttcatcttggatgatttcattcctaacttcaagaagcccatcgccttgattgcagtctcagagaagggttccatgaacctcatgctgcaagtaaacatgacttcaggccactcttcagctcctccaaaggagacaagcattggcatccttgcagctgctgtcagccgattggagcagacaccaatgcctatcatatttggaagcgggacagtggtgactgtattgcagcaactggcaaatgagtttcccttccctgtcaatataatcctgagcaacccatggctatttgaaccacttataagcaggtttatggagagaaatcccttaaccaatgcaataatcaggaccaccacggcactcaccatattcaaagcaggggtcaagttcaatgtcatccccccagtggcccaggccacagtcaacttccggattcaccctggacagacagtccaagaggtcctagaactcacgaagaacattgtggctgataacagagtccagttccatgtgttgagtgcctttgaccccctccccgtcagcccttctgatgacaaggccttgggctaccagctgctccgccagaccgtacagtccgtcttcccggaagtcaatattactgccccagttacttctattggcaacacagacagccgattctttacaaacctcaccactggcatctacaggttctaccccatctacatacagcctgaagacttcaaacgcatccatggagtcaacgagaaaatctcagtccaagcctatgagacccaagtgaaattcatctttgagttgattcagaatgctgacacagaccaggagccagtttctcacctgcacaaactgtgaggtcaaggggcctgctgggttaggcatgcccgaccccgggacaggactaacccaagggggaaagctagtgttgatgaaacttttgatcaaaaccacattgtaaaacattgcccatctgtcttgctcactcttaaactctcccaagaacaaggccggggtaaggtaaagtcagcagaaatctggcttctcccttcctcccgacatctgcatcccttgatccactggcatttgctgccctcttgtcccttatctgtcttatgctggttatttcactgcttcaccttccaggcttgacttaacaaatgtagatttgagaaatctcaaccagttgttacctgataggagtctttaatttagggcactcttgctgggatgctttctccagagcttatatatttcttcttactagaactttcttcccccttttattcccctctcttcttggactcatgagctgtctcttcatctctcctctctctcctgcatctctccccttactcttcaatttattctacttctggacctggacttacccaaactgtgatactaccataattgtcaccataatcagtcaaataaagtgatctgtgcatcacca

SEQ ID NO: 164231 - DNA, 4708 bp, Homo sapiens
  Payload ID: 12340
  Gene Symbol: PM20D2
  Gene Name: peptidase M20 domain containing 2
  Uniprot ID: Q8IYS1
  ENST ID: ENST00000275072
  CDS Start-End: 96-1406
gggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacgcgctgcccggcatcggccacgcctgcggccacaacctcatcgctgaggtcggggcggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttcctttttttgttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgcttttcggttttaacaaattctccacatgtgaactactcaagaaattttccctttttaattgcctctatagcactcataagagctagggcattaggataaactagaatattttatgtttatgaatacttgtataaacttaaaagtgttttgatttcccacaatttcccaaaggaatgtttatttattaagagttgtgttgataatttaactgttacaatttcagcagttgaattcagtgaacactggttgaggagtgcctatttctaagcactgggtgtaagaagaaaagacacttgcaaaggaagagctaagattaacataatttctttggtttttctattgcttgttattattatgtaaaaactgggtggcagttcacaaggaagattgttgtaacagaagagtgacaaccaatagttttttgatcattaaatcaaattttgtaaacagtggcaggagcgtggacttaaaacaaggcttgcttatttggttttgtcaaagttttacgaaaatatatgatatatatttatactaaaactatataatccttagatttaggaaagcaatcagttaatgtctttagcacactaaagcagtattaaacacaggtacaagttggaaattgtagaaaactgaaagaaaacaagacaaaatgtctatggtagggaataaaagagtttaagatattatgtaaaattatgtgtattttcttctcttttacataaattgtttgtgaaaagtgtgctcaacttttttacaagagtgatattaacttggatttatttttcaatataatttggagaccctttgttatccaaataaaattgatgagtttctgtgcctgtaaaaaaaaaaaaaaaaaaaagaaaagaaaagacactgttgcatgccccagaaagcttgtggtgggtggtaagttctcacgagatttatttatctgagcaacattgggactgagggaacatctgaaagctaccatcttgaaaatttttgaggaagtgtttctgaaatatttaaaaatacttaagtcagtcattttgaacaaaagaaattgatacaataagtttttttttttaaggatgattgtctaattttgtaatatgttgttttttaaaaacctgtctgatggtgttttatacatttctaactttttacctgagttatctctttagtcttttggaaaataccctacacaatactaacctttaaaactatcaaatttttgttataagataaatgttatctttgtactagatagcaaccctttataaggttgtaaggtataataaactgcttatttttttacatacttcatatcaagcattttgcagtccaattatatagttgaggatggtgtattttgatatgtatgaagttaatattttcaagtaagcaatcagtctactaccatcagattataagcttttttgtaataataggtacataaaatgtgtatgaaaaatctacaataaacatgtttatctgata

SEQ ID NO: 164232 - DNA, 1158 bp, Homo sapiens
  Payload ID: 12341
  Gene Symbol: PDF
  Gene Name: peptide deformylase (mitochondrial)
  Uniprot ID: Q9HBH1
  ENST ID: ENST00000288022
  CDS Start-End: 26-757
ccgggtcactgttaagggggccgccatggcccggctgtggggcgcgctgagtctttggccactgtgggcggccgtgccgtggggcggggcggcagccgtcggtgtccgggcttgcagctccacggccgccccggacggcgtcgagggcccggcgctgcggcgctcctattggcgccacctgaggcgtctggtgctgggtcctcccgaaccgccgttctcgcacgtgtgccaagtcggggacccggtgctgcgcggcgtggcggccccggtggagcgggcgcagctaggcgggcccgagctgcagcggctgacgcaacggctggtccaggtgatgcggcggcggcgctgcgtgggcctaagcgcgccgcagctgggggtgccgcggcaggtgctggcgctggagctccccgaggcgctgtgtcgggagtgcccgccccgccagcgcgcgctccgccaaatggagcccttccccctgcgcgtgttcgtgaaccccagcctgcgagtgcttgacagccgcctggtcacctttcccgagggctgcgagagcgtcgccggcttcctggcctgcgtgccccgcttccaggcggtgcagatctcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 164233 - DNA, 1053 bp, Homo sapiens
  Payload ID: 12342
  Gene Symbol: PYY
  Gene Name: peptide YY
  Uniprot ID: P10082
  ENST ID: ENST00000360085
  CDS Start-End: 542-835
gcccctggaggaactgaacccactatcggtcatggggccgagactaaatgtggcgggttgtctttaatctgctgccaagaggaaactcattcaggcaagttcagccctttatgaggaattcccctgtggtcacattccaattcctggacctgctgccaccctcagaactgcatgctccttcttcagactttctaagaatgactcaggtcattggtggagtgaagtcaagatttccaactcagtcacctgaagagatggagataccattcatggagctggaggtccctggagatttgggaattcagataacaagctaagataaggagtttgcctacctctgtcctagagcgaagcctgagccttgggcgcgcagcacaccacaagtatctgttactgtgttttgcagaagcttcaggcggggatataagccccacaaggaaagcgctgagcagaggaggcctcagcttgacctgcggcagtgcagcccttgggacttccctcgccttccacctcctgctcgtctgcttcacaagctatcgctatggtgttcgtgcgcaggccgtggcccgccttgaccacagtgcttctggccctgctcgtctgcctaggggcgctggtcgacgcctaccccatcaaacccgaggctccccgcgaagacgcctcgccggaggagctgaaccgctactacgcctccctgcgccactacctcaacctggtcacccggcagcggtatgggaaaagagacggcccggacacgcttctttccaaaacgttcttccccgacggcgaggaccgccccgtcaggtcgcggtcggagggcccagacctgtggtgaggacccctgaggcctcctgggagatctgccaaccacgcccacgtcatttgcatacgcactcccgaccccagaaacccggattctgcctcccgacggcggcgtctgggcagggttcgggtgcggccctccgcccgcgtctcggtgcccccgccccctgggctggagggctgtgtgtggtccttccctggtcccaaaataaagagcaaattccacagaaa

SEQ ID NO: 164234 - DNA, 580 bp, Homo sapiens
  Payload ID: 12342
  Gene Symbol: PYY
  Gene Name: peptide YY
  Uniprot ID: P10082
  ENST ID: ENST00000592796
  CDS Start-End: 92-364
agaggaggcctcagcttgacctgcggcagtgcagcccttgggacttccctcgccttccacctcctgctcgtctgcttcacaagctatcgctatggtgttcgtgcgcaggccgtggcccgccttgaccacagtgcttctggccctgctcgtctgcctaggggcgctggtcgacgcctaccccatcaaacccgaggctccccgcgaagacgcctcgccggaggagctgaaccgctactacgcctccctgcgccactacctcaacctggtcacccggcagcggtatgggaaaagagacggcccggacacgcttctttccaaaacgttcttccccgacggcgaggaccgccccgtcaggtcgcggtaaaagcgcccgttaccacacatcctgcatccgagagcgcggcctggccctaccctggcaacatcacttaacgacgtctcccaggctcgcctccccagatccaattccttccccttcgcttccgcaggtcggagggcccagacctgtggtgaggacccctgaggcctcctgggagatctgccaaccacgcccacgtcatttgcatacgcactcccgacc

SEQ ID NO: 164235 - DNA, 720 bp, Homo sapiens
  Payload ID: 12343
  Gene Symbol: PGLYRP1
  Gene Name: peptidoglycan recognition protein 1
  Uniprot ID: O75594
  ENST ID: ENST00000008938
  CDS Start-End: 45-635
ccgggcgctcctagcggtctcccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctcaaaa

SEQ ID NO: 164236 - DNA, 2758 bp, Homo sapiens
  Payload ID: 12344
  Gene Symbol: PGLYRP2
  Gene Name: peptidoglycan recognition protein 2
  Uniprot ID: Q96PD5
  ENST ID: ENST00000292609
  CDS Start-End: 131-2035
attcgccgctggactttgacagtggtcaaaggctctgctcagttctctgtgcctgtctccctccagcactgccgaggttctctgccgaggccaaccagaaataccccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaaggaatatggggtggtgctggcacctgatggctcgaccgtggctgtggagcctctgctggcggggctggaggcagggctgcaagggcgcagggtcataaatttgcccttggacagcatggctgccccttgggagactggagatacctttccagatgttgtggccattgctccagatgtaagagccacctcctccccaggactcagggatggctctccagatgtcaccactgcagatattggagccaacactccagatgctacaaaaggctgtccagatgtccaagcttccttgccagatgccaaagccaagtccccaccgaccatggtggacagcctcctggcagtcaccctggctggaaacctgggcctgaccttcctccgaggttcccagacccagagccatccagacctgggaactgagggctgctgggaccagctctctgcccctcggacctttacgcttttggaccccaaggcatctctgttaaccatggccttcctcaatggcgccctggatggggtcatccttggagactacctgagccggactcctgagccccggccatccctcagccacttgctgagccagtactatggggctggggtggccagagacccagggttccgcagcaacttccgacggcagaacggtgctgctctgacttcagcctccatcctggcccagcaggtgtggggaacccttgtccttctacagaggctggagccagtacacctccagcttcagtgcatgagccaagaacagctggcccaggtggctgccaatgctaccaaggaattcactgaggccttcctgggatgcccggccatccacccccgctgccgctggggagcggcgccttatcggggccgcccgaagctgctgcagctgccgctgggattcttgtacgtgcatcacacctacgtgcctgcaccaccctgcacggacttcacgcgctgcgcagccaacatgcgctccatgcagcgctaccaccaggacacgcaaggctggggagacatcggctacagtttcgtggtgggctcggacggctacgtgtacgagggacgcggctggcactgggtgggcgcccacacgctcggccacaactcccggggcttcggcgtggccatagtgggcaactacaccgcggcgctgcccaccgaggccgctctgcgcacggtgcgcgacacgctcccgagttgtgcggtgcgcgccggcctcctgcggccagactacgcgctgctgggccaccgccagctggtgcgcaccgactgccccggcgacgcgctcttcgacctgctgcgcacctggccgcacttcaccgcggtgagtcttcgcagcctgcactacacggcccgccgcccctccgtctacacaagctccacgaggcccctgccccctgcctgtaacagctgtgcccgcacagcctcagccaggcccccaacttcccggcggcacgtctattcaggaaacctaggcccagcctttgcgggtcactctgcgggcaacatccctgatcctgtgacttctgcctatgcagcctcagctcagccccagacccagccagcctgtcctttccccagctcctaatacctctacctttccagccaaggcatggaccctgacacctgccaacagcccctctgccctcacaacctcagcctggccttcatgacttctctacccaagtcacaacctgtcaggctgcaccacctcatcctggcccgccgaaccttgacctcacccctgcccctacccgaaggccctctgtccacacaacatgaacctaggctgtgaccttttgccttcacaacctctgtccagtccttaatcctgtgttgcaattctctgtccagacaatctcaactctgaggttgcttgtttcgtccctgactccttaacccctgatgacaactcttatgccagcacaactttgacctgatgacctcatcccagcccttgatcgccatcactaaaacaattttagaatcacacctggacaatctcgtgctacctacatactgccactccatttcattaagctattgactagcacatccatctcggcctatagttggctttgtcctcactctctcactttgggccactgtcccctccctgatccagggttccaccaccaggagggcagacccagccacataccacaaccacccccaagcctcacactcccttgtctttttccagactgttaagccaagacctgccaggagtgtctctaagagatccaggagggagccacccccaaggaccctgccagccacagacctccaataaagacagcatggaaacaaa

SEQ ID NO: 164237 - DNA, 2230 bp, Homo sapiens
  Payload ID: 12344
  Gene Symbol: PGLYRP2
  Gene Name: peptidoglycan recognition protein 2
  Uniprot ID: Q96PD5
  ENST ID: ENST00000340880
  CDS Start-End: 482-2212
gcttctctcctctccctcaacacagccggtcttaccagtacagcaggcggcagctgagagtcccctctggtggccagcagcggctacagagccgtcactatggggagggacaggacttgaggggttgcctcggtccacctcactggagaatgggcagagtttatggagtctgaaccacctggtctccaggcccctctggggatgggcctggcttactgaccactgacctcagcctaggagggacagaagagactgggggagaccaggatgcccagatgaccttgacccagggtacgctgccccatgtccctgctgcctcccgcccacagctctacgagaggcaggtctgtcattcgccgctggactttgacagtggtcaaaggctctgctcagttctctgtgcctgtctccctccagcactgccgaggttctctgccgaggccaaccagaaataccccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaaggaatatggggtggtgctggcacctgatggctcgaccgtggctgtggagcctctgctggcggggctggaggcagggctgcaagggcgcagggtcataaatttgcccttggacagcatggctgccccttgggagactggagatacctttccagatgttgtggccattgctccagatgtaagagccacctcctccccaggactcagggatggctctccagatgtcaccactgcagatattggagccaacactccagatgctacaaaaggctgtccagatgtccaagcttccttgccagatgccaaagccaagtccccaccgaccatggtggacagcctcctggcagtcaccctggctggaaacctgggcctgaccttcctccgaggttcccagacccagagccatccagacctgggaactgagggctgctgggaccagctctctgcccctcggacctttacgcttttggaccccaaggcatctctgttaaccatggccttcctcaatggcgccctggatggggtcatccttggagactacctgagccggactcctgagccccggccatccctcagccacttgctgagccagtactatggggctggggtggccagagacccagggttccgcagcaacttccgacggcagaacggtgctgctctgacttcagcctccatcctggcccagcaggtgtggggaacccttgtccttctacagaggctggagccagtacacctccagcttcagtgcatgagccaagaacagctggcccaggtggctgccaatgctaccaaggaattcactgaggccttcctgggatgcccggccatccacccccgctgccgctggggagcggcgccttatcggggccgcccgaagctgctgcagctgccgctgggattcttgtacgtgcatcacacctacgtgcctgcaccaccctgcacggacttcacgcgctgcgcagccaacatgcgctccatgcagcgctaccaccaggacacgcaaggctggggagacatcggctacagtttcgtggtgggctcggacggctacgtgtacgagggacgcggctggcactgggtgggcgcccacacgctcggccacaactcccggggcttcggcgtggccatagtgggcaactacaccgcggcgctgcccaccgaggccgctctgcgcacggtgcgcgacacgctcccgagttgtgcggtgcgcgccggcctcctgcggccagactacgcgctgctgggccaccgccagctggtgcgcaccgactgccccggcgacgcgctcttcgacctgctgcgcacctggccgcacttcaccgcgactgttaagccaagacctgccaggagtgtctctaagagatccaggagggagccacccccaaggaccctgccagccacagacctccaataaagacagcatggaaacaaa

SEQ ID NO: 164238 - DNA, 651 bp, Homo sapiens
  Payload ID: 12344
  Gene Symbol: PGLYRP2
  Gene Name: peptidoglycan recognition protein 2
  ENST ID: ENST00000594637
  CDS Start-End: 335-651
acagccggtcttaccagtacagcaggcggcagctgagagtcccctctggtggccagcagcggctacagagccgtcactatggggagggacaggacttgaggggttgcctcggtccacctcactggagaatgggcagagtttatggagtctgaaccacctggtctccaggcccctctggggatgggcctggcttactgaccactgacctcagcctaggagggacagaagagactgggggagaccaggatgcccagatgaccttgacccaggcactgccgaggttctctgccgaggccaaccagaaataccccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaa

SEQ ID NO: 164239 - DNA, 578 bp, Homo sapiens
  Payload ID: 12344
  Gene Symbol: PGLYRP2
  Gene Name: peptidoglycan recognition protein 2
  ENST ID: ENST00000601792
  CDS Start-End: 36-578
aattccccttcaggaaaagcaggcaggtctcagtcatgggcacccggagaagaggaaggacatttcactgtcagcccagcactgccgaggttctctgccgaggccaaccagaaataccccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaaggaatatggggtggtgctggcacctgatggctcgaccgtggctgtggagcctctgctggcggggctggaggcagggctgcaagggcgcagggtcataaatttgcccttggacagcatg

SEQ ID NO: 164240 - DNA, 1173 bp, Homo sapiens
  Payload ID: 12345
  Gene Symbol: PGLYRP3
  Gene Name: peptidoglycan recognition protein 3
  Uniprot ID: Q96LB9
  ENST ID: ENST00000290722
  CDS Start-End: 54-1079
cctctcttccagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgaccctgcctgtggcctacatcatcacagaccagctcccagggatgcagtgccagcagcagagcgtttgcagccagatgctgcgggggttgcagtcccattccgtctacaccataggctggtgcgacgtggcgtacaacttcctggttggggatgatggcagggtgtatgaaggtgttggctggaacatccaaggcttgcacacccagggctacaacaacatttccctgggcatcgccttctttggcaataagataggcagcagtcccagccctgctgccttatcagctgcagagggtctgatctcctatgccatccagaagggtcacctgtcgcccaggtatattcagccacttcttctgaaagaagagacctgcctggaccctcaacatccagtgatgcccaggaaggtttgccccaacatcatcaaacgatctgcttgggaagccagagagacacactgccctaaaatgaacctcccagccaaatatgtcatcatcatccacaccgctggcacaagctgcactgtatccacagactgccagactgtcgtccgaaacatacagtcctttcacatggacacacggaacttttgtgacattggatatcacttcctggtgggccaggatggtggcgtgtatgaaggggttggatggcacatccaaggctctcacacttatggattcaacgatattgccctaggaattgccttcatcggctactttgtagaaaagcctccaaatgctgcagcgctggaggcggcccaggacctgatccagtgtgccgtggttgaggggtacctgactccaaactacctgctgatgggccacagtgacgtggtcaacatcctgtcccctgggcaggctttgtataacatcatcagcacctggcctcatttcaagcactgaaggaggccccactccctttgagactgccctccctcccctgctgggtctctccaaccctcaccagccaaggtggctcagcaccttgtgtccccct

SEQ ID NO: 164241 - DNA, 1834 bp, Homo sapiens
  Payload ID: 12346
  Gene Symbol: PGLYRP4
  Gene Name: peptidoglycan recognition protein 4
  Uniprot ID: Q96LB8
  ENST ID: ENST00000359650
  CDS Start-End: 66-1187
acaggacccacagatatctgctgccatccacactctccagattggtgtcctgggaccacgtggggatgctgccgtggcttcttgtcttctctgctctgggtatccaggcctggggtgattcctcctggaacaaaacacaagctaaacaggtatcagaggggctccagtacctatttgagaacatctcccagctcactgaaaaaggccttcccacagatgtctccaccacggtctctcgcaaggcatggggggcagaagctgttggctgcagtattcagctgaccacgccagtgaatgtccttgttatacaccatgtccctggactggagtgtcacgaccagacagtctgcagccagagactgcgggaactgcaggcccatcatgtccacaacaacagtgggtgtgatgtggcctacaacttcctggttggggatgatggcagggtgtatgaaggtgttggctggaatatccaaggagtgcacacccaaggctacaacaacatctccctgggctttgccttctttggcactaagaaaggccacagtcccagccctgctgccctgtcggccatggaaaacctaatcacctatgctgtccagaagggccacctgtcatccagttatgttcagccacttcttgggaaaggcgagaactgcctggcccctcggcagaagacaagcctgaagaaggcttgccccggcgttgtcccacggtctgtgtggggagccagggagacccactgtcccaggatgactctcccagcgaagtatggcatcattatccacactgccgggaggacctgcaacatttctgatgagtgccgcctgctggtccgggacatccagtctttctacatagacaggctcaagtcatgcgacattggttataacttcctggtgggccaggatggcgccatttatgaaggggtgggctggaatgtccaaggctcctccacccctggctacgatgacattgccctgggcattaccttcatgggcaccttcacaggtataccacccaatgctgcagcactagaggcagcccaagacctgatccagtgtgccatggtcaaagggtacctgactcccaactacctgctggtgggccacagtgatgtggcccgaaccttgtctcctgggcaggctttgtacaacatcatcagcacctggcctcatttcaaacactgagagaagccccaggtccttctgagactgctttccctcccctgtcaggtctctcctgtcctaaccatccagcttggctcaacaccttttgccctcctcccctgccacacagtcctgtgcctcctttttcaggttgggatgatcatgccctctcctgccaacatcctccaagggcctccaaacctcatagctggacattcacagccctctgagtctgagtccagatttcttctctccttaccttcctctcccttggaaacccaactcctcagccaggtgagacaatgggctggttcttgtttcatttctctctctctctccattcccctctgcctggtgagccttcccctggtgtctgcctggcagcccccacctcccacctatcacccctcacccataactcaggtcaacgtgaccaaccttccttgcttacacataaacttgtatatatttggatgtagcccttatttaatggctgtcattatttatagatatgtctatccttgctacttggttgtgagtttctccaggggaggaactgtgttttattcatctctatgtcctctgtttctcagcagtgtctgaaatttaatgggttctactgatgtttattagagaaatggatgaataaatgaatgaagagatccaaa

SEQ ID NO: 164242 - DNA, 2116 bp, Homo sapiens
  Payload ID: 12346
  Gene Symbol: PGLYRP4
  Gene Name: peptidoglycan recognition protein 4
  Uniprot ID: Q96LB8
  ENST ID: ENST00000368739
  CDS Start-End: 360-1469
cttgcatttctccaggtgctgtgaaaggagctggctcagagccttgccctctgtcttcccttctccccatcttttgttagggatcctgggctctcttctctctgggaagctagagcccgagtgctccattcccagggagggagtgccctctagggctagggagagtgaaggctggaggagaaggcgccagttggtgaagaagggcagggcctggaggccaagtctggaagggaaggagctgctggccaatcaggggcaagctgactgcaccctgacctgctgggctgggacagcacaggacccacagatatctgctgccatccacactctccagattggtgtcctgggaccacgtggggatgctgccgtggcttcttgtcttctctgctctgggtatccaggcctggggtgattcctcctggaacaaaacacaagctaaacaggtatcagaggggctccagtacctatttgagaacatctcccagctcactgaaaaagatgtctccaccacggtctctcgcaaggcatggggggcagaagctgttggctgcagtattcagctgaccacgccagtgaatgtccttgttatacaccatgtccctggactggagtgtcacgaccagacagtctgcagccagagactgcgggaactgcaggcccatcatgtccacaacaacagtgggtgtgatgtggcctacaacttcctggttggggatgatggcagggtgtatgaaggtgttggctggaatatccaaggagtgcacacccaaggctacaacaacatctccctgggctttgccttctttggcactaagaaaggccacagtcccagccctgctgccctgtcggccatggaaaacctaatcacctatgctgtccagaagggccacctgtcatccagttatgttcagccacttcttgggaaaggcgagaactgcctggcccctcggcagaagacaagcctgaagaaggcttgccccggcgttgtcccacggtctgtgtggggagccagggagacccactgtcccaggatgactctcccagcgaagtatggcatcattatccacactgccgggaggacctgcaacatttctgatgagtgccgcctgctggtccgggacatccagtctttctacatagacaggctcaagtcatgcgacattggttataacttcctggtgggccaggatggcgccatttatgaaggggtgggctggaatgtccaaggctcctccacccctggctacgatgacattgccctgggcattaccttcatgggcaccttcacaggtataccacccaatgctgcagcactagaggcagcccaagacctgatccagtgtgccatggtcaaagggtacctgactcccaactacctgctggtgggccacagtgatgtggcccgaaccttgtctcctgggcaggctttgtacaacatcatcagcacctggcctcatttcaaacactgagagaagccccaggtccttctgagactgctttccctcccctgtcaggtctctcctgtcctaaccatccagcttggctcaacaccttttgccctcctcccctgccacacagtcctgtgcctcctttttcaggttgggatgatcatgccctctcctgccaacatcctccaagggcctccaaacctcatagctggacattcacagccctctgagtctgagtccagatttcttctctccttaccttcctctcccttggaaacccaactcctcagccaggtgagacaatgggctggttcttgtttcatttctctctctctctccattcccctctgcctggtgagccttcccctggtgtctgcctggcagcccccacctcccacctatcacccctcacccataactcaggtcaacgtgaccaaccttccttgcttacacataaacttgtatatatttggatgtagcccttatttaatggctgtcattatttatagatatgtctatccttgctacttggttgtgagtttctccaggggaggaactgtgttttattcatctctatgtcctctgtttctcagcagtgtctgaaatttaatgggttctactgatgtttattagagaaatggatgaataaatgaatgaagagatccaaa

SEQ ID NO: 164243 - DNA, 3846 bp, Homo sapiens
  Payload ID: 12347
  Gene Symbol: PADI1
  Gene Name: peptidyl arginine deiminase, type I
  Uniprot ID: Q9ULC6
  ENST ID: ENST00000375471
  CDS Start-End: 93-2084
tcagaactcacacttcttcctggcaaagaagtgcccaggacgggagctggggagccagggctgatctaggaggctgggagccaggtgacaggatggccccaaagagagttgtgcagctgtccctgaagatgcctacccatgccgtgtgtgtggtgggagtcgaggcacatgtggacattcacagtgatgtgcccaagggtgccaacagcttcagggtctctggaagctccggggtggaggtcttcatggtctacaaccgcacacgtgtgaaagagcccataggcaaggcccgttggccgctagacactgatgcagacatggtcgtatctgtgggcacagccagtaaggaattaaaggacttcaaggtgagggtctcctactttggggagcaggaagaccaagctctgggccgcagcgtgctttacctcactggcgtcgatatttcccttgaggttgacacaggccgcacaggcaaggtgaagaggagccaaggggacaagaaaacctggcgctggggccctgagggctatggggctatcttgctggtgaactgtgaccgggacaatcacaggtccgcagagcctgacctcacccacagctggctgatgtcgctggctgacctgcaggacatgtccccaatgctgctgagctgcaatggccccgacaagctcttcgacagccacaagcttgtcttgaacgtgcccttttctgattccaaaagagtgagggtcttctgtgccaggggtgggaattctctctcggactacaaacaggtgctggggccccagtgtctgtcctatgaagttgagcgacagccaggggagcaggagatcaagttctatgtggaggggctgaccttccccgatgccgatttcctagggctggtttccctcagtgtcagcctggtggacccggggaccctgcccgaggtgaccctcttcacagacactgtgggcttccgcatggccccctggatcatgacgcccaacactcagcctcctgaggagctgtatgtgtgcagagtgatggacactcatggctccaatgagaaattcctggaggacatgtcttatctgacattgaaagccaactgcaagctgaccatctgccctcaagttgaaaatcgaaatgaccgctggatccaggacgagatggagtttggctacatcgaggcccctcacaaatccttccccgtggtctttgactcccccaggaacaggggcctgaaagatttcccctataagaggatcctgggtcctgactttggatatgttacccgggagatcccgctccctggtccctccagccttgactccttcggcaacctggacgtcagcccgcccgtcacggtgggcggcacggaataccccctgggccggatcctcatcgggagcagcttccccaagtccggtgggcggcagatggccagggcagtgcggaacttcctgaaggcacagcaggtgcaggcacccgtggagctctactcggactggctctctgtgggccatgtggacgagtttctgacctttgtgcctacctctgaccaaaagggcttccggctgctcctggctagccccagcgcttgcctcaaactcttccaagagaagaaagaagagggttatggggaggcagcccagtttgatgggttaaaacaccaggcaaaaagaagcattaatgagatgctggcagacagacacctccagagagacaatcttcatgcacagaaatgcattgactggaaccgtaatgtgctgaagcgggagctgggcctggcagagagtgacatcgtggacattccccagctcttcttcctgaaaaacttctacgcggaagccttcttcccagacatggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagatgggccccacttagaattgctcccccttcattctgatgcctccctggggaacaaggataatgactttgcatctgcacctggaacggggcctgggggacctggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggcaggaggggatgaggtcagggtagcagagtgtgtgacgacggatttgggggcctagaggtgtccgtggttcctgggctgggattttggactctggatttgaagggagctggagcttccagatgtagcaggggtagggggccagatgttagaagagggtgtgtgtgttgggaggaaattaggttatctctgaaggtggagtttaatttcctttaatagtctttaattattccccttcattctgcaggcagtgggaggggaaggcttgcccggtctctctcagcaacccagggaccctgcacatagcttaggtttcatccctgaataaaccgctgtgcaggcccatgtcccctcccacagtagggaagacagctgccacgggaggttaatagcccggagtgaggtcactgagacatgcacaggcaggctggttcagctgggctgcagggcacgggcaggaggaagccagcctaccctcttcccccactgccagtgaggccattgtagggcagttggccctagggcttcggtccatctaggttttcagtggcccctgctgagacctcacactgagccaactactgtcactgttttaaccaacaaaagctagcctggaactgctatggttaaagtgggtgagcgggaacctgaaaatccccttctggaaggttctacagaactctatttgcaagctcctgctttaacctgagcgtcctctgctcaggatcataccccagcctgcactgagtcaagaaggagaaggaggctctgaaggggccgggggtgtgagctggggttgggactcccctgagaaagagctgtgggtaggaagggagtgagcattgcagagatagggctgggggtcggggccacactgagtgtgggaagctctggagttgctgctgggccatcgaggggccctggtgttggctctgagaatgttctgggtgaccagtcacctactttctgatcaataaaaatgtcgacatgcatttctta

SEQ ID NO: 164244 - DNA, 3846 bp, Homo sapiens; identical to SEQ ID NO: 164243
  Payload ID: 12347
  Gene Symbol: PADI1
  Gene Name: peptidyl arginine deiminase, type I
  Uniprot ID: Q9ULC6
  ENST ID: ENST00000631074
  CDS Start-End: 93-2084

SEQ ID NO: 164245 - DNA, 1607 bp, Homo sapiens
  Payload ID: 12348
  Gene Symbol: PADI2
  Gene Name: peptidyl arginine deiminase, type II
  Uniprot ID: Q9Y2J8
  ENST ID: ENST00000375481
  CDS Start-End: 65-1378
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtaagagaagccaggctggggctaggggctgtgggagtggggaagtcactgtttctcttttggggtggcctgggttgctcacacatggagcaagtggctgggggaattattccctcccacgacttcctgttaagaggccgacactcttggaaagaaaatcaagctagcctttatatctttgtgtgatttaggatctaatatataactaaataaacaactcttttccccaagtg

SEQ ID NO: 164246 - DNA, 4345 bp, Homo sapiens
  Payload ID: 12348
  Gene Symbol: PADI2
  Gene Name: peptidyl arginine deiminase, type II
  Uniprot ID: Q9Y2J8
  ENST ID: ENST00000375486
  CDS Start-End: 65-2062
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcgcccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttcttttttttctttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtca

SEQ ID NO: 164247 - DNA, 3189 bp, Homo sapiens
  Payload ID: 12349
  Gene Symbol: PADI3
  Gene Name: peptidyl arginine deiminase, type III
  Uniprot ID: Q9ULW8
  ENST ID: ENST00000375460
  CDS Start-End: 41-2035
agtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagccgctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggcccaggtggtggagacagagacaggcccctgaacgataagcaccaagagaccccaaggctccagatggaacactgagggtgaccgtccctctcagaagccttttccctggaagtgtccatgcctcacctgcaacccatgtggttctcagacttgaatcttctcggccccccaaaaagaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccctaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctgtcacatagtaggagcttctagatgcatgtggaagcaatgagagttgtcccttagccttataaactccccatgatctgacatgcagaaatccagccttgtccagaatcctcctggaatttcttggagacgaaagtatctgggggattgttgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggaatgaaccactgaattcaggggatgggggtgggggggcggttctcgaggtgtgtgccagctacacgtgtgttctgtatgggtccagctgcgtttccatcactcgctaataaatcaacagaaacacaaa

SEQ ID NO: 164248 - DNA, 3189 bp, Homo sapiens; identical to SEQ ID NO: 164247
  Payload ID: 12349
  Gene Symbol: PADI3
  Gene Name: peptidyl arginine deiminase, type III
  Uniprot ID: Q9ULW8
  ENST ID: ENST00000625769
  CDS Start-End: 41-2035

SEQ ID NO: 164249 - DNA, 2267 bp, Homo sapiens
  Payload ID: 12350
  Gene Symbol: PADI4
  Gene Name: peptidyl arginine deiminase, type IV
  Uniprot ID: Q9UM07
  ENST ID: ENST00000375448
  CDS Start-End: 27-2018
agccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacggccctccagccaagaagaaatccacaggttcctccacatggcccctggaccctggggtagaggtgaccctgacgatgaaagtggccagtggtagcacaggcgaccagaaggttcagatttcatactacggacccaagactccaccagtcaaagctctactctacctcaccggggtggaaatctccttgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacggggcaaactgtcctccaagtgcagcgtagtcttgggtcccaagtggccctctcactacctgatggtccccggtggaaagcacaacatggacttctacgtggaggccctcgctttcccggacaccgacttcccggggctcattaccctcaccatctccctgctggacacgtccaacctggagctccccgaggctgtggtgttccaagacagcgtggtcttccgcgtggcgccctggatcatgacccccaacacccagcccccgcaggaggtgtacgcgtgcagtatttttgaaaatgaggacttcctgaagtcagtgactactctggccatgaaagccaagtgcaagctgaccatctgccctgaggaggagaacatggatgaccagtggatgcaggatgaaatggagatcggctacatccaagccccacacaaaacgctgcccgtggtcttcgactctccaaggaacagaggcctgaaggagtttcccatcaaacgcgtgatgggtccagattttggctatgtaactcgagggccccaaacagggggtatcagtggactggactcctttgggaacctggaagtgagccccccagtcacagtcaggggcaaggaatacccgctgggcaggattctcttcggggacagctgttatcccagcaatgacagccggcagatgcaccaggccctgcaggacttcctcagtgcccagcaggtgcaggcccctgtgaagctctattctgactggctgtccgtgggccacgtggacgagttcctgagctttgtgccagcacccgacaggaagggcttccggctgctcctggccagccccaggtcctgctacaaactgttccaggagcagcagaatgagggccacggggaggccctgctgttcgaagggatcaagaaaaaaaaacagcagaaaataaagaacattctgtcaaacaagacattgagagaacataattcatttgtggagagatgcatcgactggaaccgcgagctgctgaagcgggagctgggcctggccgagagtgacatcattgacatcccgcagctcttcaagctcaaagagttctctaaggcggaagcttttttccccaacatggtgaacatgctggtgctagggaagcacctgggcatccccaagcccttcgggcccgtcatcaacggccgctgctgcctggaggagaaggtgtgttccctgctggagccactgggcctccagtgcaccttcatcaacgacttcttcacctaccacatcaggcatggggaggtgcactgcggcaccaacgtgcgcagaaagcccttctccttcaagtggtggaacatggtgccctgagcccatcttccctggcgtcctctccctcctggccagatgtcgctgggtcctctgcagtgtggcaagcaagagctcttgtgaatattgtggctccctgggggcggccagccctcccagcagtggcttgctttcttctcctgtgatgtcccagtttcccactctgaagatcccaacatggtcctagcactgcacactcagttctgctctaagaagctgcaataaagtttttttaagtcactttgtacatga

SEQ ID NO: 164250 - DNA, 841 bp, Homo sapiens
  Payload ID: 12350
  Gene Symbol: PADI4
  Gene Name: peptidyl arginine deiminase, type IV
  ENST ID: ENST00000375453
  CDS Start-End: 29-412
acagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacggccctccagccaagaagaaatccacaggttcctccacatggcccctggaccctggggtagaggtgaccctgacgatgaaagtggccagtggtagcacaggcgaccagaaggttcagatttcatactacggacccaagactccaccagtcaaagctctactctacctcaccggggtggatggagtctcaccctgtcacccaggctggagtgcaatggcatgatctcggctcactgcaacctgcgtctcccaggttcaagcgatcctcctgcttcagcgtccctagtagctgggactacaggcgcttgccaccacgcctggctaatttttgtatttttagtagagatggagtttcaccatgttggccaggctggtctcgaacttctgacctcaggtgatctgcctgcctcaggctcccaaagtgctcggattactggcatgaaccactgcgccaggccctctattcctttttgatacctcaaatatctataacaaaaagtagataatgacactgtcttatacaagaatatagatagtgttcctcaaattccattatttatatctcatcttcaccatttctgccatatcaatgatccacctatactcatatttatgtaatgttcttctttaaataaaatccattcttaaactt

SEQ ID NO: 164251 - DNA, 2396 bp, Homo sapiens
  Payload ID: 12351
  Gene Symbol: PADI6
  Gene Name: peptidyl arginine deiminase, type VI
  Uniprot ID: Q6TGC4
  ENST ID: ENST00000619609
  CDS Start-End: 51-2135
gggcgtctgaggctgctgtgctgagtgagggctgcggtgcaggcctgaggatggtcagcgtggagggccgagccatgtccttccagagtatcatccacctgtccctggacagccctgtccatgccgtttgtgtgttgggcacagaaatctgcttggatctcagcgggtgtgccccccagaagtgccagtgcttcaccatccatggctctgggagggtcttgatcgatgtggccaacacggtgatttctgagaaggaggacgccaccatctggtggcccctgtctgatcccacgtacgccacagtgaagatgacatcgcccagcccttccgtggatgcggataaggtctcggtcacatactatgggcccaacgaggatgcccccgtgggcacagctgtgctgtacctcactggcattgaggtctctctagaggtagacatctaccgcaatgggcaagttgagatgtcaagtgacaaacaggctaagaaaaaatggatctggggtcccagcggttggggtgccatcctgcttgtgaattgcaaccctgctgatgtgggccagcaacttgaggacaagaaaaccaagaaagtgatcttttcagaggaaataacgaatctgtcccagatgactctgaatgtccaaggccccagctgtatcttaaagaaatatcggctagtcctccatacctccaaggaagagtcgaagaaggcgagagtctactggccccaaaaagacaactccagtacctttgagttggtgctggggcccgaccagcacgcctataccttggccctcctcgggaaccacttgaaggagactttctacgttgaagctatagcattcccatctgccgaattctcaggcctcatctcctactctgtgtccctggtggaggagtctcaagacccgtcaattccagagactgtgctgtacaaagacacggtggtgttccgggtggctccctgtgtcttcattccctgtacccaggtgcctctggaggtttacctgtgcagggagctgcagctgcagggttttgtggacacagtgacgaagctgagtgagaagagcaacagccaggtggcatctgtctatgaggaccccaaccgcctgggcaggtggctccaggatgagatggccttctgctacacccaggctccccacaagacaacgtccttgatcctcgacacacctcaggccgccgatctcgatgagttccccatgaagtactcactgagccctggtattggctacatgatccaggacactgaggaccataaagtggccagcatggattccattgggaacctgatggtgtccccacctgtcaaggtccaagggaaagagtacccgctgggcagagtcctcattggcagcagcttttaccccagcgcagagggccgggccatgagtaagaccctccgagacttcctctatgcccagcaggtccaagcgccggtggagctctactcagattggctaatgactggccacgtggatgagttcatgtgcttcatccccacagatgacaagaatgagggcaaaaagggcttcctgctgctcctggccagccccagtgcctgctataaactgttccgagagaaacagaaggaaggctatggcgacgctcttctgtttgatgagcttagagcagatcagctcctgtctaatggaagggaagccaaaaccatcgaccaacttctggctgatgaaagcctgaagaagcagaatgaatacgtggagaagtgcattcacctgaaccgtgacatcctgaagacggagctgggcctggtggaacaggacatcatcgagattccccagctgttctgcttggagaagctgactaacatcccctctgaccagcagcccaagaggtcctttgcgaggccatacttccctgacctgttgcggatgattgtgatgggcaagaacctggggatccccaagccttttgggccccaaatcaaggggacctgctgcctggaagaaaagatttgctgcttgctggagcccctgggcttcaagtgcaccttcatcaatgactttgactgttacctgacagaggtcggagacatctgtgcctgtgccaacatccgccgggtgccctttgccttcaaatggtggaagatggtaccttagacccaggccctggagctgccagctctgccccagcgtggatggcccactgtcaccatgcaacagcatgattctttgcccagtagaggaggctggagagtccaggcaacagaaccctttcttccctgtctgccccgaccgaccctcggacccagtaggatggcaaatgccgccagcttgaacccctatggggaaaagatgcaaaagtgttcagccaagtgacgtttactaaatagccaataaagggctggtgggtgtgaatgc

SEQ ID NO: 164252 - DNA, 3302 bp, Homo sapiens
  Payload ID: 12352
  Gene Symbol: PAM
  Gene Name: peptidylglycine alpha-amidating monooxygenase
  Uniprot ID: P19021
  ENST ID: ENST00000346918
  CDS Start-End: 460-3123
aatgtattaaagaacctcagctgggatttgctgaggacaaatgctgtaacgtgttagtcatccattatctgcttctatttttgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcc

SEQ ID NO: 164253 - DNA, 3684 bp, Homo sapiens
  Payload ID: 12352
  Gene Symbol: PAM
  Gene Name: peptidylglycine alpha-amidating monooxygenase
  ENST ID: ENST00000345721
  CDS Start-End: 378-905
gcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagttgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgac

SEQ ID NO: 164254 - DNA, 3156 bp, Homo sapiens
  Payload ID: 12352
  Gene Symbol: PAM
  Gene Name: peptidylglycine alpha-amidating monooxygenase
  Uniprot ID: P19021
  ENST ID: ENST00000304400
  CDS Start-End: 187-3111
gaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagcagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtc

SEQ ID NO: 164255 - DNA, 3622 bp, Homo sapiens
  Payload ID: 12352
  Gene Symbol: PAM
  Gene Name: peptidylglycine alpha-amidating monooxygenase
  Uniprot ID: P19021
  ENST ID: ENST00000348126
  CDS Start-End: 374-2974
gttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagca

SEQ ID NO: 164256 - DNA, 2567 bp, Homo sapiens
  Payload ID: 12352
  Gene Symbol: PAM
  Gene Name: peptidylglycine alpha-amidating monooxygenase
  ENST ID: ENST00000379799
  CDS Start-End: 1-2038
aatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagcagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattct

SEQ ID NO: 164257 - DNA, 5432 bp, Homo sapiens
  Payload ID: 12352
  Gene Symbol: PAM
  Gene Name: peptidylglycine alpha-amidating monooxygenase
  Uniprot ID: P19021
  ENST ID: ENST00000438793
  CDS Start-End: 471-3392
gtgaaactactaatgtattaaagaacctcagctgggatttgctgaggacaaatgctgtaacgtgttagtcatccattatctgcttctatttttgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcattagctgtcagtgtattttccagtttttgcgtatttgcagattttacatacaacttttataataattacacaaacccacaaatattagtgaaacttactcgatgtcttcaactaaaagaaatgtgtgtattgtacaaaatttagaagatactttagccaatataaattaaaaaccagcctgagtttacataaatttgtaaagtcaggctcttctaaaatccaaagagggtttttgcctatatatcaatcagaggataaatactttaataaaaggtaatcacagctaagtggatacctgtgtctcaaattacatatgcaaatgatccatcagtagggatcactaataatagttttccttttaaaaaataatttcagggcaggtacagtggctcaagcctatacttccaggactttgggaggccaagcagaaggattgtgggaggccaagcagaaggattgtttgagcccagaaattcaaggctgcagtgagctatgatcaatccactgtactccagcctaggctacagagtgagatcctttctctaaaataaaatacaatttccatgtatccataggaatatattcatcttttacagtgattgcagattagttttaaaacgtctttttcgtaattcgtcaatgcaagttagtaagaaccagataattttccattttaaaatgataggaatctaaaactctttttcaaaaatgccaacctgtttttccggcatcatagtagttggaataatacagatataattgactaatcataaagtacatgagagtacagaagggaaatttggaaacggtaagtctgctagggcattacaatcctgtcctagcactccacctttattctgccaacctgggttaattaaagatggtagcctggaaagtaatgaatgacattgacttcaggcaatctttccactgattattcttggctgaacttcatttatcgagtcagagaatgcactgcctgagaaatgtcccagaggagtgaatcctaggcctggccacagtagaatcgcctggagaatttaagaaaaaaattgttgggcactcactctttccagtgatctttatttagttggcttacaatggaatacaggtatggttcatgtttttaaatttgtccaggtgtttctattgtgcagtcacagttgaaaaccattgtcttcgagaatagctattctatcttgccagttacaataagtggatagctatattttcacataaattatagtttacagatgtttggagggggaagacaggatctgaggtgttttgatatgactgttagcaccaaaatctgaatgccttaattgttgaatgtgttaaattggataattaaaatgggcataaatgacttattaaaaaagcaaagggaaa

SEQ ID NO: 164258 - DNA, 2898 bp, Homo sapiens
  Payload ID: 12352
  Gene Symbol: PAM
  Gene Name: peptidylglycine alpha-amidating monooxygenase
  Uniprot ID: P19021
  ENST ID: ENST00000455264
  CDS Start-End: 81-2798
ggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgta

SEQ ID NO: 164259 - DNA, 575 bp, Homo sapiens
  Payload ID: 12352
  Gene Symbol: PAM
  Gene Name: peptidylglycine alpha-amidating monooxygenase
  ENST ID: ENST00000512073
  CDS Start-End: 501-575
gcgcaggttggtgttgttgccgctgctgccgccactgcgaggcggtcagggcaagggtgagggtgggggcgcggaagggggcctgggctcgggatcctgctgccaccaattcctggtgccccaggaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactt

SEQ ID NO: 164260 - DNA, 570 bp, Homo sapiens
  Payload ID: 12352
  Gene Symbol: PAM
  Gene Name: peptidylglycine alpha-amidating monooxygenase
  ENST ID: ENST00000505654
  CDS Start-End: 484-570
gctaccacaccagattctgaaggggaggagttgtctggaaagaccagagctgggtgctggggatctggagcagctcgggacccgcgctgcagggagctgggatgggagaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaag

SEQ ID NO: 164261 - DNA, 528 bp, Homo sapiens
  Payload ID: 12352
  Gene Symbol: PAM
  Gene Name: peptidylglycine alpha-amidating monooxygenase
  ENST ID: ENST00000511477
  CDS Start-End: 403-528
aattctgtgatgatccttgggagctcttggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgt

SEQ ID NO: 164262 - DNA, 616 bp, Homo sapiens
  Payload ID: 12352
  Gene Symbol: PAM
  Gene Name: peptidylglycine alpha-amidating monooxygenase
  ENST ID: ENST00000506006
  CDS Start-End: 532-616
gatgcatgtatataagcatgcctttgttctcaaaagtctttttctatctgattactgtggtatccagtgctttgtctttgcctctcttcgttttttgttttgtttttttccttgcgccttagccggtcatttgtgtgatgtttacattcagcagagaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtcttta

SEQ ID NO: 164263 - DNA, 564 bp, Homo sapiens
  Payload ID: 12352
  Gene Symbol: PAM
  Gene Name: peptidylglycine alpha-amidating monooxygenase
  ENST ID: ENST00000509832
  CDS Start-End: 406-564
atttttggtgagagaaaggagtgatagaggaagttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgat

SEQ ID NO: 164264 - DNA, 1417 bp, Homo sapiens
  Payload ID: 12352
  Gene Symbol: PAM
  Gene Name: peptidylglycine alpha-amidating monooxygenase
  ENST ID: ENST00000504691
  CDS Start-End: 1-752
gtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcattagctgtcagtgtatt

SEQ ID NO: 164265 - DNA, 609 bp, Homo sapiens
  Payload ID: 12352
  Gene Symbol: PAM
  Gene Name: peptidylglycine alpha-amidating monooxygenase
  ENST ID: ENST00000511839
  CDS Start-End: 405-609
acttatcatgaagaatctcacttcatttaaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacaccta

SEQ ID NO: 164266 - DNA, 997 bp, Homo sapiens
  Payload ID: 12353
  Gene Symbol: PIN1
  Gene Name: peptidylprolyl cis/trans isomerase, NIMA-interacting 1
  Uniprot ID: Q13526
  ENST ID: ENST00000247970
  CDS Start-End: 23-514
aggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 164267 - DNA, 878 bp, Homo sapiens
  Payload ID: 12353
  Gene Symbol: PIN1
  Gene Name: peptidylprolyl cis/trans isomerase, NIMA-interacting 1
  ENST ID: ENST00000587625
  CDS Start-End: 23-460
aggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtgcgcaaggaatgggcctcaccaggttgggggacccttaccaccctgaggggtagaggccaggagggtctgggcattgggctcccaggtgccacaccggccttcggggtccagcaggtggcagcacagccccttcctcaggcttcagaggctgctctgctgggcagggccagggccacacagggaggggggctgcagcactttcttcctggcatcatctctaccctggggggcatggtctcttgtgtgtctgtgcacagatgtcctcatcccaggcccaccaaggtgggtacatcctgtcctctgcctcttcctttttgtggtttaaggttgagggccctgagagtcccagggcctgtcccccagaatccctctcaaaggtggggaaaccaggggtgagaggaggtggccctgagtttaggcctgtctggccaggacagtggaaatcagggacagaggggactaggcctcctc

SEQ ID NO: 164268 - DNA, 533 bp, Homo sapiens
  Payload ID: 12353
  Gene Symbol: PIN1
  Gene Name: peptidylprolyl cis/trans isomerase, NIMA-interacting 1
  ENST ID: ENST00000591777
  CDS Start-End: 1-271
gcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 164269 - DNA, 648 bp, Homo sapiens
  Payload ID: 12353
  Gene Symbol: PIN1
  Gene Name: peptidylprolyl cis/trans isomerase, NIMA-interacting 1
  Uniprot ID: Q13526
  ENST ID: ENST00000588695
  CDS Start-End: 5-496
gaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 164270 - DNA, 755 bp, Homo sapiens
  Payload ID: 12353
  Gene Symbol: PIN1
  Gene Name: peptidylprolyl cis/trans isomerase, NIMA-interacting 1
  ENST ID: ENST00000586352
  CDS Start-End: 1-152
tggcggacgaggagaagctgccgcccggctgggagaagcgcatgagccgcagctcaggtgagaacaccaaggcccagggaagatatatcacatttgaacccagattcagatttgaatccaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttgggg

SEQ ID NO: 164271 - DNA, 1780 bp, Homo sapiens
  Payload ID: 12354
  Gene Symbol: PIN4
  Gene Name: peptidylprolyl cis/trans isomerase, NIMA-interacting 4
  ENST ID: ENST00000218432
  CDS Start-End: 36-371
aattgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaac

SEQ ID NO: 164272 - DNA, 1321 bp, Homo sapiens
  Payload ID: 12354
  Gene Symbol: PIN4
  Gene Name: peptidylprolyl cis/trans isomerase, NIMA-interacting 4
  Uniprot ID: Q9Y237
  ENST ID: ENST00000373669
  CDS Start-End: 33-503
tgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagcta

SEQ ID NO: 164273 - DNA, 577 bp, Homo sapiens
  Payload ID: 12354
  Gene Symbol: PIN4
  Gene Name: peptidylprolyl cis/trans isomerase, NIMA-interacting 4
  ENST ID: ENST00000439980
  CDS Start-End: 1-276
gttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatgaattacaccactggcttgcctggttctccagcttgcagacagaagactgtgggacttctcagcctctataatcttctccttcccagctagccactcacaaccccgccatgggcctcagaattgctaaagggacatcagaccatactacacatcattagatctcaatgaagaacacctctagttggcccgtctctttgtgaggtgccacccttgacatcaagtgcaggcctcgacgttgttggcatttcagagccttggcagaagttggataaattggcgggaagtgatgctgccagctggag

SEQ ID NO: 164274 - DNA, 776 bp, Homo sapiens
  Payload ID: 12354
  Gene Symbol: PIN4
  Gene Name: peptidylprolyl cis/trans isomerase, NIMA-interacting 4
  ENST ID: ENST00000446576
  CDS Start-End: 1-350
caaaggaaaaagtggttctggaaaagcggggaaaggtagagcggccagagcgatcaaggagaatgggggcgggtgaggagcgaagggagggaacagacagtccatctccggagtccgggacggacgcagcagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatctt

SEQ ID NO: 164275 - DNA, 1605 bp, Homo sapiens
  Payload ID: 12354
  Gene Symbol: PIN4
  Gene Name: peptidylprolyl cis/trans isomerase, NIMA-interacting 4
  Uniprot ID: Q9Y237
  ENST ID: ENST00000423432
  CDS Start-End: 36-437
aattgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaaagtggattattttgcagatggctgatctcatctattcaatgttgattctattagttccaatttcagaaggtgacattttctgactttgtccccttaagcacaaacaaaaactatggatttttgtttttgttttcagaaaagagaaagtacaaggtgtgcttggggaacagcaaggaaaccagacagatgtgggggcgggtttgtaggggaactgctggatgtacctcattaatttgttcatttgttcagcacccacagggtgccagtgaacgggctaggtgctggggatagagtggtgaacaagatgagccttatgcacctcacagtctcctgggggagacagccaaatagacaattttaatacaatgtggcaaattctatgatgggaagaagagagaaatggtgtgtgtgagtccctcaccttcccagaggtttcccaggggaagcaacgtttcagctgagacctgaaggatggatgacagtccaccagaaaaaagttagtggagcggggacaagcagggttgcagagtggaagaaaaatgttcctgtgagaagaaactgtccaaagagtctgaagagaaaagggaacagggtgaatttgaggccctacaagaaaaacaggagaccattcaacaggagacgcccagggagcaggtggctttgtgggcctgatgtccaagaaagaagtcgtggtggtaaacagagacttgggattgcaagctactgttgtctttctattgaaaaaatagctgagcaccacactagggaggccttgcaaggacagcccaaagaatttgaacttgattctacaggcagtgattttgaacaagaggttttgaagagaacgtgacacacgtcaagctgagctctagggagtgggcagcagcctgcagaagagggactaggctaggagcacagaaagtagcccacggcagaggtagcagaaggaatggaggagtgcccatgtgaggggtactgaggtggcacacttgccagaatcagggcagcctgcttggtctcataccagctggaaccagttcctaccagctcccaagggctaattgttaaactttcaggaattttctcagcattcattaaaaatgaaaaaaagtatcaatattaaaaatatttttgctggacatggtgtctcaggcctgtaatcccagct

SEQ ID NO: 164276 - DNA, 1094 bp, Homo sapiens
  Payload ID: 12354
  Gene Symbol: PIN4
  Gene Name: peptidylprolyl cis/trans isomerase, NIMA-interacting 4
  ENST ID: ENST00000373662
  CDS Start-End: 359-679
cgccgagggactgcagagccacccacccccgtggctcctactgcgcacgcgtgaaaaaagccaggttgaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttattggtcagacatcttcagccccattggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagcttgtcaactatcattagtgttagcgtattttgtgtggcccaagataattcttccattgtggcccagggaagctgaaaggttggatacccttgttgtaaagtgtctggccgagttcccttttgaagtgtggcgttatgatggaaatatccactccggttgtgtgttggacctttctgtaaacatggaggtgcagtttaaatgagtacctgtcatctcttctctaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaa

SEQ ID NO: 164277 - DNA, 678 bp, Homo sapiens
  Payload ID: 12354
  Gene Symbol: PIN4
  Gene Name: peptidylprolyl cis/trans isomerase, NIMA-interacting 4
  ENST ID: ENST00000496835
  CDS Start-End: 1-348
gttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaaagtggattattttgcagatggctgatctcatctattcaatgttgattctattagttccaatttcagaaggtgacattttctgactttgtccccttaagcacaaacaaaaactatggatttttgtttttgttttcagaaaagagaaagtacaaggtgtgcttggggaacagcaaggaaaccagacagatgtgggggcgggtttgtaggggaactgctggatgtacctcattaatttgttcatttgttcagcacccacagggtgccagtgaacgggctaggtgctggggatagagtggtgaacaagatgagccttatgcacctcacagtctc

SEQ ID NO: 164278 - DNA, 1739 bp, Homo sapiens
  Payload ID: 12355
  Gene Symbol: PPIL1
  Gene Name: peptidylprolyl isomerase (cyclophilin)-like 1
  Uniprot ID: Q9Y3C6
  ENST ID: ENST00000373699
  CDS Start-End: 253-753
cggtatcgccacttggagaccaccgcgaatgaagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaattcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaatt

SEQ ID NO: 164279 - DNA, 4929 bp, Homo sapiens
  Payload ID: 12356
  Gene Symbol: PPIL2
  Gene Name: peptidylprolyl isomerase (cyclophilin)-like 2
  Uniprot ID: Q13356
  ENST ID: ENST00000335025
  CDS Start-End: 92-1654
ggaagtggtcacggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacgaacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaataattctttttcttcaagtacatccagggtagaaaatgaaatctgacttttcctcggtccagtgtgttactctatagacatggaccagccactcagcaactgcctgacacctaagctgctgtcactgctgagggcacaacccctggtaccagaccctgtgaggctgtcacctcagtaagggcacctctgcgggccccgggacagccttctctaagggctagctcacctgctttctagataaggaatctactggcttaaataaacatgttccactagacacca

SEQ ID NO: 164280 - DNA, 2574 bp, Homo sapiens
  Payload ID: 12356
  Gene Symbol: PPIL2
  Gene Name: peptidylprolyl isomerase (cyclophilin)-like 2
  Uniprot ID: Q13356
  ENST ID: ENST00000398831
  CDS Start-End: 79-1641
gaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctcccctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggcca

SEQ ID NO: 164281 - DNA, 3875 bp, Homo sapiens
  Payload ID: 12356
  Gene Symbol: PPIL2
  Gene Name: peptidylprolyl isomerase (cyclophilin)-like 2
  Uniprot ID: Q13356
  ENST ID: ENST00000406385
  CDS Start-End: 61-1623
atggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccagctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaa

SEQ ID NO: 164282 - DNA, 557 bp, Homo sapiens
  Payload ID: 12356
  Gene Symbol: PPIL2
  Gene Name: peptidylprolyl isomerase (cyclophilin)-like 2
  ENST ID: ENST00000458567
  CDS Start-End: 78-557
aactcggctgcggctccatggtctgagttgtcagccgttgttttttcgtgctcgctagtcgccgccgccgctccgccatggggaagcgacagcaccaaaaggacaaaatagacagattctcgctttgttgccccagctgttctccaacgcctggactcaagcaatcttcctgccttggcctcccaaactgttgggattataggtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgag

SEQ ID NO: 164283 - DNA, 4213 bp, Homo sapiens
  Payload ID: 12356
  Gene Symbol: PPIL2
  Gene Name: peptidylprolyl isomerase (cyclophilin)-like 2
  ENST ID: ENST00000417788
  CDS Start-End: 78-203
aactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagctgtcaaaactatcaagactacaataacaagagcactgtcataattttaatggaagtaaaaaatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgatcttgctatgttgtctaagctggtcttgaattcctggcttcaagtgagagcctcctgccttggcctccgaaagtgctggaattacaggcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctcccctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccagctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattctt

SEQ ID NO: 164284 - DNA, 2625 bp, Homo sapiens
  Payload ID: 12356
  Gene Symbol: PPIL2
  Gene Name: peptidylprolyl isomerase (cyclophilin)-like 2
  Uniprot ID: Q13356
  ENST ID: ENST00000626352
  CDS Start-End: 79-1662
gaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccaccgagcagcagaggaagagccctcaaccagtgccactgtccccatgtccaagaagaagcccagtcggggttttggggacttcagctcctggtagcagcaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacga

SEQ ID NO: 164285 - DNA, 1370 bp, Homo sapiens
  Payload ID: 12357
  Gene Symbol: PPIL3
  Gene Name: peptidylprolyl isomerase (cyclophilin)-like 3
  Uniprot ID: Q9H2H8
  ENST ID: ENST00000286175
  CDS Start-End: 385-882
gtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggctatgtgtataaggtatatatgaaacgtaaatgaacttcatgtttaaatttg

SEQ ID NO: 164286 - DNA, 1194 bp, Homo sapiens
  Payload ID: 12357
  Gene Symbol: PPIL3
  Gene Name: peptidylprolyl isomerase (cyclophilin)-like 3
  Uniprot ID: Q9H2H8
  ENST ID: ENST00000392283
  CDS Start-End: 270-755
gtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggcta

SEQ ID NO: 164287 - DNA, 897 bp, Homo sapiens
  Payload ID: 12357
  Gene Symbol: PPIL3
  Gene Name: peptidylprolyl isomerase (cyclophilin)-like 3
  ENST ID: ENST00000409361
  CDS Start-End: 259-732
aggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaagtatggaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatcccca

SEQ ID NO: 164288 - DNA, 725 bp, Homo sapiens
  Payload ID: 12357
  Gene Symbol: PPIL3
  Gene Name: peptidylprolyl isomerase (cyclophilin)-like 3
  ENST ID: ENST00000409264
  CDS Start-End: 1-543
ctgcgattgcatttttcctgttttaacaacggctgtgctagacgaagtggtgaagcccaatctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattct

SEQ ID NO: 164289 - DNA, 756 bp, Homo sapiens
  Payload ID: 12357
  Gene Symbol: PPIL3
  Gene Name: peptidylprolyl isomerase (cyclophilin)-like 3
  Uniprot ID: Q9H2H8
  ENST ID: ENST00000409449
  CDS Start-End: 131-628
ggcggaagtggtcctttccgtttggcagccgagtgtaaagcattgcttgaggttgcccagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaat

SEQ ID NO: 164290 - DNA, 313 bp, Homo sapiens
  Payload ID: 12357
  Gene Symbol: PPIL3
  Gene Name: peptidylprolyl isomerase (cyclophilin)-like 3
  ENST ID: ENST00000443398
  CDS Start-End: 94-313
aagcattgcttgaggttgcccagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgaggaactggaagaggaggcaacagtatttggggcaagaagtttgaggatgaatacagtgaatatcttaagcacaatgttagaggtgttgtatctatggctaataatggcccgaacaccaatggatctcagttcttcatcaccta

SEQ ID NO: 164291 - DNA, 748 bp, Homo sapiens
  Payload ID: 12357
  Gene Symbol: PPIL3
  Gene Name: peptidylprolyl isomerase (cyclophilin)-like 3
  ENST ID: ENST00000415562
  CDS Start-End: 73-234
agagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgaggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaat

SEQ ID NO: 164292 - DNA, 596 bp, Homo sapiens
  Payload ID: 12357
  Gene Symbol: PPIL3
  Gene Name: peptidylprolyl isomerase (cyclophilin)-like 3
  ENST ID: ENST00000457063
  CDS Start-End: 357-596
ccgcactgcactccagcctggcgacatagcgagactccgtctcaaaatgaaaaaaaaagagaagttcatagtatattagtgataagtgctgtggtggaaaaaaaaaagttcatagtatattagtataagtgctgtggtgaaaaaaaaaaaaagcgaatttcatagtatattagtgataagtgctgtgggagaaggaaataggaatgtcctagggctgaagggctaaagcagttctgtgtaggattgtcaggtcagttaaacttgacatttaagcagaaatttggagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaag

SEQ ID NO: 164293 - DNA, 2232 bp, Homo sapiens
  Payload ID: 12358
  Gene Symbol: PPIL4
  Gene Name: peptidylprolyl isomerase (cyclophilin)-like 4
  Uniprot ID: Q8WUA2
  ENST ID: ENST00000253329
  CDS Start-End: 34-1512
cccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaaattgatgatttcaaaggaagatcagctgaggaagtagaagaaataaaggcagaaaaagaggctaaaactcaggctatacttttggagatggtgggagacctacctgatgcagatattaaacctccagaaaatgtactgtttgtgtgtaaattgaacccagtgaccacagatgaggatctggaaataatattctctagatttgggccaataagaagttgtgaagttatccgagactggaagacaggagagtccctctgttacgcttttattgaatttgaaaaggaagaagattgtgagaaagcattcttcaaaatggacaatgtgcttatagatgacagaagaatacatgtggattttagccagtcggttgcaaaggttaaatggaaaggaaaaggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatggacatttgagttttgtttatttgtttttgctgttgaaacaatgctgctgtgaacattgtatctagcagttatattgcttgatatattgataaaataatgccaaatttgtgttctgaa

SEQ ID NO: 164294 - DNA, 1089 bp, Homo sapiens
  Payload ID: 12358
  Gene Symbol: PPIL4
  Gene Name: peptidylprolyl isomerase (cyclophilin)-like 4
  ENST ID: ENST00000340881
  CDS Start-End: 535-918
acacactatctcgttagatctttaaaaggtctcttaaagtctcacttctctcaaacttaggtctttcagatcttaaactcaggtcccaaatcctcagttttccactggacttaatgttctcatgggctcaatggctctacttgaacacggcatttgtgtgtaatttatttgaaagtttgatgttgtaatattcacatatatcgttaggtggcagcatgtggctacctagcaaaaatggatgtctgatttcaaattagtaatggagatggaattactatgattcttttgttccctttctctgtctctcgatatatgccatttataaaatagctcttatgctttttataaaataattattgttcttggttaggtggtttttttactaagctctttttttcttttcttaataaataggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacatttt

SEQ ID NO: 164295 - DNA, 1445 bp, Homo sapiens
  Payload ID: 12359
  Gene Symbol: PPIL6
  Gene Name: peptidylprolyl isomerase (cyclophilin)-like 6
  ENST ID: ENST00000447468
  CDS Start-End: 34-825
gtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagacggagtctctctgtcacccatgctggagtgcaatggcgtgatctcggctcactgcaacctccacctcccaggttcaagtgattctcctgcctcagcctcctgagcagctgggattacagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggc

SEQ ID NO: 164296 - DNA, 1693 bp, Homo sapiens
  Payload ID: 12359
  Gene Symbol: PPIL6
  Gene Name: peptidylprolyl isomerase (cyclophilin)-like 6
  Uniprot ID: Q8IXY8
  ENST ID: ENST00000440797
  CDS Start-End: 582-1595
cagcagttgaggttgaagatccgcagtcgcagggagaagttgggcttcatggttggggagctccaggggcgctaggcggctcgaactctccagcgacggccgcggtggggacgggggcggccggcggcgccttctccccagaccgttccttcttcgcaggcggcgcgcacaggtgggcaccaagcccgcgtggctcaggtcgggcccgactcccgcgttcccccggcaaccggccggctgttcccaatcaggcgggccgccaacccggaaaggcgatccgctgccgaaatccgggcgcccaggctcggtaagggccgcgcgctaggaccctgggggtccggagagcgcccccgggtgggcggctcccggttccttttcctccaagctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagagctttatggaagcttgaaaagaagtgtaaagaggcagaaggaaagcagaggggttggaaagatcgagaaataccgagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaa

SEQ ID NO: 164297 - DNA, 4031 bp, Homo sapiens
  Payload ID: 12359
  Gene Symbol: PPIL6
  Gene Name: peptidylprolyl isomerase (cyclophilin)-like 6
  Uniprot ID: Q8IXY8
  ENST ID: ENST00000424445
  CDS Start-End: 582-1421
cagcagttgaggttgaagatccgcagtcgcagggagaagttgggcttcatggttggggagctccaggggcgctaggcggctcgaactctccagcgacggccgcggtggggacgggggcggccggcggcgccttctccccagaccgttccttcttcgcaggcggcgcgcacaggtgggcaccaagcccgcgtggctcaggtcgggcccgactcccgcgttcccccggcaaccggccggctgttcccaatcaggcgggccgccaacccggaaaggcgatccgctgccgaaatccgggcgcccaggctcggtaagggccgcgcgctaggaccctgggggtccggagagcgcccccgggtgggcggctcccggttccttttcctccaagctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccagcacttgggaggccgaggcaggtggatcacaagatcaagagattgagaccatcctggccaacatggtgaaaccctgtctctactaaaactacagaaattagctgggcatggtggcatgcacttgtagtcccagctacttgggaagctgaggcagaagaatctcttgaacccgggaggcggaggttgcagtgagccgagatgccgccactgcactccagcctggcgacagagagagactgtctcaaaaaaaaagaaaggccaagtactgcagagatgtcagccccagtctcttgagctgcgggaccaataccagcaaccacctactctggacttcttattataggagactaacagagccctgtgttgtgttgtttatgttactgttggttgagaattttgttacttgtggacaaaaaattcttaatttagcaacacacctgatagcctaagacatttgtaatagaattatgttcttgtttgtaactacatgtactcctaggagaaacttggtaagtaaccaaataggaatgatgcagaagaaaaagcaattcattgtaatatttcattgtttataccagcattcagaaagagtatctacactttggatgttttcatatatgacatgaacatcatccttatctctctgagccataccaaccctatgaaaaccaagggcttgttttacagtgtccgtggtggctgactcatgtgatgttattggagattcagctttatcactactctgtaatctaaagttctcaagctcatatcacctggggagcttttaaaatgtaacctaacagaccttgtccttgacctactgaggcagagttcccaggcgtggggcagagattctgtgttcatttggttctttccccagggttcccaggcgtggggcacagattctgtgttcatttagctctttccccagggttcccatttagacagctgggcactagtcatctgggaatcactgcaagacataaggaactggttccagtccccatggtgtaatgtagtcagcagagtgcttgactctgctattggtgaccttgctcagctcctgttaccaccactaccctgtgcccctgctctgcccagactaagagtgcttttctttttttttttttttttttttttttttttgagacggaatctcactctgtcgcccaggctggagtgcagtggcacaatctcggctcactgcaagctctgcctccctgattcatgccattctcctgcctcagcctcccgagtagctgggactacaggcgcctgccaccacgcctggctaattttttgtatttttagtagagatgggatttcaccatgttagccaggatggtcccgatcttgtgacctcgtgatccgcccgcctcggcctcccaaagtgctgagattacaaaggcgtgagccaccgcacccggctgagagtgcttttcttaccctaagcagaatgaggtttgtcttccaagaacaatctctatttacatcagtcttaaagaggcaggcttctaatggatatgaggcttgccaaaagtaggcgtaggcttttttaactttttattttgaaatatagattcacaggaagttgcaaaaatagtacagagcagtcctgtgtacctttcacccattttccccagtggctacgcttacaaaacggtagtacaatatcaaaccaggcagctgacattggtacaatgtgtgtgatgccattttatcatgagtatattcatgtaaccaacactatagagaaaatatagaacctttccagcacctcaaagacccccttccagtacccctttacagtcaacccactcccctgccctctgccatccctaactcctgacaactggcatttgcttttccttttaatgacagctttattgctatatgacatatgctttatgctaagacctgaggtggatgggaggaagcagaccgcctatgttacattctcaactgacccagagcaacatagtgttaagaatgtgtgttctagggccagaatcctggctctgccattccctagctgcacaaactcaggcaagaacttttctgtgcctcaattccttcatctgagaaacagtggtacctaccacataagattgctgtgagggttccatgaatcaataatttctataaagaacctataagagacctggtctgctgtaagcactcgataaatttaataataaattactaatgtgtaaccttc

SEQ ID NO: 164298 - DNA, 617 bp, Homo sapiens
  Payload ID: 12359
  Gene Symbol: PPIL6
  Gene Name: peptidylprolyl isomerase (cyclophilin)-like 6
  ENST ID: ENST00000417394
  CDS Start-End: 1-617
gctaggtgcggctcgccgtcgctgccggagcggccgctgcaggtgaaggtggtggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaagg

SEQ ID NO: 164299 - DNA, 607 bp, Homo sapiens
  Payload ID: 12359
  Gene Symbol: PPIL6
  Gene Name: peptidylprolyl isomerase (cyclophilin)-like 6
  ENST ID: ENST00000520723
  CDS Start-End: 1-514
ggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaaggcaactgattgaaggaacagaagtgcttaaacaactagaattagttccaacacagaatgaaagaccaatacatatgtgtagaattactgacagtggagatc

SEQ ID NO: 164300 - DNA, 4128 bp, Homo sapiens
  Payload ID: 12359
  Gene Symbol: PPIL6
  Gene Name: peptidylprolyl isomerase (cyclophilin)-like 6
  Uniprot ID: Q8IXY8
  ENST ID: ENST00000521072
  CDS Start-End: 582-1517
cagcagttgaggttgaagatccgcagtcgcagggagaagttgggcttcatggttggggagctccaggggcgctaggcggctcgaactctccagcgacggccgcggtggggacgggggcggccggcggcgccttctccccagaccgttccttcttcgcaggcggcgcgcacaggtgggcaccaagcccgcgtggctcaggtcgggcccgactcccgcgttcccccggcaaccggccggctgttcccaatcaggcgggccgccaacccggaaaggcgatccgctgccgaaatccgggcgcccaggctcggtaagggccgcgcgctaggaccctgggggtccggagagcgcccccgggtgggcggctcccggttccttttcctccaagctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccagcacttgggaggccgaggcaggtggatcacaagatcaagagattgagaccatcctggccaacatggtgaaaccctgtctctactaaaactacagaaattagctgggcatggtggcatgcacttgtagtcccagctacttgggaagctgaggcagaagaatctcttgaacccgggaggcggaggttgcagtgagccgagatgccgccactgcactccagcctggcgacagagagagactgtctcaaaaaaaaagaaaggccaagtactgcagagatgtcagccccagtctcttgagctgcgggaccaataccagcaaccacctactctggacttcttattataggagactaacagagccctgtgttgtgttgtttatgttactgttggttgagaattttgttacttgtggacaaaaaattcttaatttagcaacacacctgatagcctaagacatttgtaatagaattatgttcttgtttgtaactacatgtactcctaggagaaacttggtaagtaaccaaataggaatgatgcagaagaaaaagcaattcattgtaatatttcattgtttataccagcattcagaaagagtatctacactttggatgttttcatatatgacatgaacatcatccttatctctctgagccataccaaccctatgaaaaccaagggcttgttttacagtgtccgtggtggctgactcatgtgatgttattggagattcagctttatcactactctgtaatctaaagttctcaagctcatatcacctggggagcttttaaaatgtaacctaacagaccttgtccttgacctactgaggcagagttcccaggcgtggggcagagattctgtgttcatttggttctttccccagggttcccaggcgtggggcacagattctgtgttcatttagctctttccccagggttcccatttagacagctgggcactagtcatctgggaatcactgcaagacataaggaactggttccagtccccatggtgtaatgtagtcagcagagtgcttgactctgctattggtgaccttgctcagctcctgttaccaccactaccctgtgcccctgctctgcccagactaagagtgcttttctttttttttttttttttttttttttttttgagacggaatctcactctgtcgcccaggctggagtgcagtggcacaatctcggctcactgcaagctctgcctccctgattcatgccattctcctgcctcagcctcccgagtagctgggactacaggcgcctgccaccacgcctggctaattttttgtatttttagtagagatgggatttcaccatgttagccaggatggtcccgatcttgtgacctcgtgatccgcccgcctcggcctcccaaagtgctgagattacaaaggcgtgagccaccgcacccggctgagagtgcttttcttaccctaagcagaatgaggtttgtcttccaagaacaatctctatttacatcagtcttaaagaggcaggcttctaatggatatgaggcttgccaaaagtaggcgtaggcttttttaactttttattttgaaatatagattcacaggaagttgcaaaaatagtacagagcagtcctgtgtacctttcacccattttccccagtggctacgcttacaaaacggtagtacaatatcaaaccaggcagctgacattggtacaatgtgtgtgatgccattttatcatgagtatattcatgtaaccaacactatagagaaaatatagaacctttccagcacctcaaagacccccttccagtacccctttacagtcaacccactcccctgccctctgccatccctaactcctgacaactggcatttgcttttccttttaatgacagctttattgctatatgacatatgctttatgctaagacctgaggtggatgggaggaagcagaccgcctatgttacattctcaactgacccagagcaacatagtgttaagaatgtgtgttctagggccagaatcctggctctgccattccctagctgcacaaactcaggcaagaacttttctgtgcctcaattccttcatctgagaaacagtggtacctaccacataagattgctgtgagggttccatgaatcaataatttctataaagaacctataagagacctggtctgctgtaagcactcgataaatttaataataaattactaatgtgtaaccttca

SEQ ID NO: 164301 - DNA, 436 bp, Homo sapiens
  Payload ID: 12359
  Gene Symbol: PPIL6
  Gene Name: peptidylprolyl isomerase (cyclophilin)-like 6
  ENST ID: ENST00000518648
  CDS Start-End: 1-436
gcggccgctgcaggtgaaggtggtggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttt

SEQ ID NO: 164302 - DNA, 863 bp, Homo sapiens
  Payload ID: 12360
  Gene Symbol: PPIA
  Gene Name: peptidylprolyl isomerase A (cyclophilin A)
  ENST ID: ENST00000415933
  CDS Start-End: 44-406
ttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaata

SEQ ID NO: 164303 - DNA, 544 bp, Homo sapiens
  Payload ID: 12360
  Gene Symbol: PPIA
  Gene Name: peptidylprolyl isomerase A (cyclophilin A)
  ENST ID: ENST00000451562
  CDS Start-End: 46-411
cgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaacggaacaaacactacttttcttcaacctttgcttccacagactttttcatccctaagatactagaagaagagcatac

SEQ ID NO: 164304 - DNA, 2238 bp, Homo sapiens
  Payload ID: 12360
  Gene Symbol: PPIA
  Gene Name: peptidylprolyl isomerase A (cyclophilin A)
  Uniprot ID: P62937
  ENST ID: ENST00000468812
  CDS Start-End: 46-543
cgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataatgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacaatctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatta

SEQ ID NO: 164305 - DNA, 907 bp, Homo sapiens
  Payload ID: 12360
  Gene Symbol: PPIA
  Gene Name: peptidylprolyl isomerase A (cyclophilin A)
  Uniprot ID: P62937
  ENST ID: ENST00000489459
  CDS Start-End: 382-699
gttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaatt

SEQ ID NO: 164306 - DNA, 552 bp, Homo sapiens
  Payload ID: 12360
  Gene Symbol: PPIA
  Gene Name: peptidylprolyl isomerase A (cyclophilin A)
  ENST ID: ENST00000479021
  CDS Start-End: 45-221
gttttgcagacgccaccgccgaggaaaaccgtgtactattagccatggtcaaccccaccgtgttcttcgacattgccgtcgacggcgagcccttgggccgcgtctcctttgagtgtgtctctatgcatggagtaagaaagaaaccatcctacaatagcaccaaatccagcatggatggctgtgttggtgcaggactttcacatgtctttggagtagaataagatgtgccaatccagactcaaccccatctcatcaagatccagtgatcttcgttttccgattgtctagcccaagctctcttcctccccagactcatcctccaccctgctactggacttgtctttgtactctcaaagcagtgtgaggagattcatcaaccggtggtgtggacatgtgaacagcgtgaggcagagagttataagcttcttgagggtggcagccagacagtagcagtttgtgtgcaaagcccctgcagtggcatatggaagactttcaatacatcaggaccagaggatgagctggaaatgaaatcacactcactggtgggagaaa

SEQ ID NO: 164307 - DNA, 818 bp, Homo sapiens
  Payload ID: 12360
  Gene Symbol: PPIA
  Gene Name: peptidylprolyl isomerase A (cyclophilin A)
  Uniprot ID: P62937
  ENST ID: ENST00000355968
  CDS Start-End: 292-609
gttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattg

SEQ ID NO: 164308 - DNA, 827 bp, Homo sapiens
  Payload ID: 12360
  Gene Symbol: PPIA
  Gene Name: peptidylprolyl isomerase A (cyclophilin A)
  Uniprot ID: P62937
  ENST ID: ENST00000620047
  CDS Start-End: 301-618
gttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattg

SEQ ID NO: 164309 - DNA, 660 bp, Homo sapiens
  Payload ID: 12361
  Gene Symbol: PPIAL4A
  Gene Name: peptidylprolyl isomerase A (cyclophilin A)-like 4A
  Uniprot ID: Q9Y536
  ENST ID: ENST00000577856
  CDS Start-End: 76-570
actataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatc

SEQ ID NO: 164310 - DNA, 600 bp, Homo sapiens
  Payload ID: 12362
  Gene Symbol: PPIAL4C
  Gene Name: peptidylprolyl isomerase A (cyclophilin A)-like 4C
  Uniprot ID: A0A0B4J2A2
  ENST ID: ENST00000585245
  CDS Start-End: 34-528
gccaccatcgctgtgagccctgtactatcagccatggtcaactccgtcgtcttttttgacatcaccgtcgacggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcactgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccacc

SEQ ID NO: 164311 - DNA, 495 bp, Homo sapiens
  Payload ID: 12363
  Gene Symbol: PPIAL4D
  Gene Name: peptidylprolyl isomerase A (cyclophilin A)-like 4D
  Uniprot ID: F5H284
  ENST ID: ENST00000544708
  CDS Start-End: 1-495
atggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaa

SEQ ID NO: 164312 - DNA, 785 bp, Homo sapiens
  Payload ID: 12364
  Gene Symbol: PPIAL4E
  Gene Name: peptidylprolyl isomerase A (cyclophilin A)-like 4E
  Uniprot ID: A0A075B759
  ENST ID: ENST00000581164
  CDS Start-End: 76-570
actataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaa

SEQ ID NO: 164313 - DNA, 660 bp, Homo sapiens
  Payload ID: 12365
  Gene Symbol: PPIAL4F
  Gene Name: peptidylprolyl isomerase A (cyclophilin A)-like 4F
  ENST ID: ENST00000369222
  CDS Start-End: 76-570
actataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaagtggttcccagtttttcatctgtgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatc

SEQ ID NO: 164314 - DNA, 660 bp, Homo sapiens
  Payload ID: 12365
  Gene Symbol: PPIAL4F
  Gene Name: peptidylprolyl isomerase A (cyclophilin A)-like 4F
  Uniprot ID: P0DN26
  ENST ID: ENST00000581138
  CDS Start-End: 76-570
actataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatc

SEQ ID NO: 164315 - DNA, 3856 bp, Homo sapiens
  Payload ID: 12366
  Gene Symbol: PPIAL4G
  Gene Name: peptidylprolyl isomerase A (cyclophilin A)-like 4G
  Uniprot ID: P0DN37
  ENST ID: ENST00000419275
  CDS Start-End: 428-922
tgccacttcactccagcctgggtgacagagcaagactctgtctcaaaaaaaaaaaaaaaaaaaaagaagaaagaaagaaagaaagaaagaaagaaagaaagaaagaaagaaagaaagaaagaaatgaagactgccacaacttggaagcaaccaagatgtccttcaatgagtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctagaaaaggccaaactataaagacagtaaaaagatcagtggttatctttgcagacgccgccatcgctgtgagccctgtactatcagccatggtcaactccgtcatcttttttgacatcaccgtcgacggcaagcccttgggccgcatctccatcaaacagtttgcagacaagattccaaagacagcagaaaactttcgtgctctgagcactggagagaaaggatttcgttataagggttcctgctttcacagaattattccagggtttatgtgtcagggtggtgacttcacacaccctaatggcaccggtgacaagtccatctatggggagaaatttgatgatgagaacctcatccgaaagcatacaggttctggcatcttgtccatggcaaatgctggacccaacacaaatggttcccagtttttcatctgcactgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttaagtttatgattatgaaataaaaactaagtaacaacaacaacaacaaaaaagctcagtggttgccaggagtttggggatgggtagggagataaatagttctgaaacaggcgatttttaggggattgaaaatacgttggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcatgtttactttcaaaagggaaagtttatattgatattgagcaagtgaaagcatgaatatttattatttgatgtttgtttctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgccaatctgtttgccagtgctgaatttcgacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgtctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccaggctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagccgagatcatgccaatgcactccagctttgtcaacagagcgagactttgtttcaaagtaaaaaaataaaaataaaaaaataaaaacgtaactggatagacctaaggttcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaatgaaatatatagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatattaggggtaataataatttaaagagtttaattactttttactactagaaaactaattttatgtttggcacaaatttctgaaatgctattccactgcaaagaataatacctatatatggccagaattactttttttctataacattaagataatacttgtcagcctgagcaacaaagtgagacctcatctttacaaaaaataaataaattagacgggtgttgtggtgatgagggtctgtagtcccagatactcaagaggctgaggtgggaggatcccttgagcctaggaggtcgcggttgcagtgaactatgattgcaccactgcactccagcctgggtaacagagcaagatcctgtctc

SEQ ID NO: 164316 - DNA, 1081 bp, Homo sapiens
  Payload ID: 12367
  Gene Symbol: PPIB
  Gene Name: peptidylprolyl isomerase B (cyclophilin B)
  Uniprot ID: P23284
  ENST ID: ENST00000300026
  CDS Start-End: 220-870
gtggcaaccacccacgagcccgcgtcggtgcccgccccgcagggggacctactatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatatataa

SEQ ID NO: 164317 - DNA, 1380 bp, Homo sapiens
  Payload ID: 12368
  Gene Symbol: PPIC
  Gene Name: peptidylprolyl isomerase C (cyclophilin C)
  Uniprot ID: P45877
  ENST ID: ENST00000306442
  CDS Start-End: 117-755
ccgcaaccgggagcgcgcaggcgcagccggccggcagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgttgtgttgtctttcaattatttgcttttttttttttactttctttttgtattctatcccagatcacaggaaagttataaaaatcaaaccgtcaccctttagtttgcttgaactttagtaaaccacctgcttagggactttgaacttaaatatatccccttcctcaagtggtgctattttaaaactaaaaaaaactttgaattggctatttttttaatgcaatattttttttctgaattcattatgatccccatattgggtaatgctgaacatttatctgaaacagatgaggatattattattttgtatccaaacagaaattcagataaagggaaatttgactagtgtaatctgagatatgtcatagggatttctttctgacaaaagggtgctttgctgttctttatattaaatacttttagatcaactctttttgcaagactttttaaaaatgtaaagttctttaagaaatatacaaaaatacacacactctagcattaacagtgaacagattagaaagattttataaatcaaactacaaacataattagataactcag

SEQ ID NO: 164318 - DNA, 1823 bp, Homo sapiens
  Payload ID: 12369
  Gene Symbol: PPID
  Gene Name: peptidylprolyl isomerase D
  Uniprot ID: Q08752
  ENST ID: ENST00000307720
  CDS Start-End: 109-1221
ggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtggagacttctcaaatcagaatgggacaggtggagaaagtatttatggtgaaaaatttgaagatgaaaatttccattacaagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaattgtgcgttattgcagaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaa

SEQ ID NO: 164319 - DNA, 789 bp, Homo sapiens
  Payload ID: 12369
  Gene Symbol: PPID
  Gene Name: peptidylprolyl isomerase D
  ENST ID: ENST00000507213
  CDS Start-End: 1-147
aaagcattgtaccgcagagctcaaggatggcaaggattaaaagaatatgatcaagcattggctgatcttaagaaagctcaggggatagcaccagaagataaaggtaagttggcagcttttgtagtgaaagttaattttgttatttaaatacttatcctcaggaaccattgttcactttgccagattttagatgtttgttcaacagacactacagaatgcctgctgttgggccaggcattatcatatagcaatgaacaagacagtcaaagtccctgccctcaaagagcttacattctactcccattcaagaatatagtagtttttcacgttatttattcttcaagttatcatctctgtagttttttatatgtctaaatactgtttgtcttatggtatcctttgagactgtgttcctattctggttagtctagtcgagagctcagcattgtaagacacagtattcatggtaaatttaacatttgggaccattcaagttgaatgtggctataaccttagtattgatgtactggttatatgttttaggaaactatgacaaaaataagcttgtttttcaaataaaccaactatgaatagtgacactagatctgggtattacaaaatgtctttggtctcttattactaaaatgaaacaagggaagcaattactgttctctaatgtagaggcagaaggcaaatcttgatgtacttgagttctctcagttgacatcctctaaaattacgtttcatttctgtgtttgtgtgattgctcagattttctgttactagggc

SEQ ID NO: 164320 - DNA, 594 bp, Homo sapiens
  Payload ID: 12369
  Gene Symbol: PPID
  Gene Name: peptidylprolyl isomerase D
  ENST ID: ENST00000512699
  CDS Start-End: 1-59
ggatattggaaaatgtggaagtgaaaggtgaaaaacctgctaaaaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggc

SEQ ID NO: 164321 - DNA, 2166 bp, Homo sapiens
  Payload ID: 12370
  Gene Symbol: PPWD1
  Gene Name: peptidylprolyl isomerase domain and WD repeat containing 1
  Uniprot ID: Q96BP3
  ENST ID: ENST00000261308
  CDS Start-End: 73-2013
agaagactgcgccgctgctttgggattggtagctgagttttgtgtcgcgccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaatta

SEQ ID NO: 164322 - DNA, 596 bp, Homo sapiens
  Payload ID: 12370
  Gene Symbol: PPWD1
  Gene Name: peptidylprolyl isomerase domain and WD repeat containing 1
  ENST ID: ENST00000514172
  CDS Start-End: 1-399
tataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaa

SEQ ID NO: 164323 - DNA, 829 bp, Homo sapiens
  Payload ID: 12370
  Gene Symbol: PPWD1
  Gene Name: peptidylprolyl isomerase domain and WD repeat containing 1
  ENST ID: ENST00000505380
  CDS Start-End: 106-829
tgttaatgtattaatgtgttggggcgcgagaggaaggcggtgcttatttcgaatcatgtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaa

SEQ ID NO: 164324 - DNA, 2019 bp, Homo sapiens
  Payload ID: 12370
  Gene Symbol: PPWD1
  Gene Name: peptidylprolyl isomerase domain and WD repeat containing 1
  ENST ID: ENST00000510930
  CDS Start-End: 16-222
gacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagcagccacatgaagttggaatttcgaactcttatttagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgc

SEQ ID NO: 164325 - DNA, 580 bp, Homo sapiens
  Payload ID: 12370
  Gene Symbol: PPWD1
  Gene Name: peptidylprolyl isomerase domain and WD repeat containing 1
  ENST ID: ENST00000515447
  CDS Start-End: 19-342
tctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgca

SEQ ID NO: 164326 - DNA, 1981 bp, Homo sapiens
  Payload ID: 12370
  Gene Symbol: PPWD1
  Gene Name: peptidylprolyl isomerase domain and WD repeat containing 1
  ENST ID: ENST00000511908
  CDS Start-End: 13-267
gatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttatt

SEQ ID NO: 164327 - DNA, 570 bp, Homo sapiens
  Payload ID: 12370
  Gene Symbol: PPWD1
  Gene Name: peptidylprolyl isomerase domain and WD repeat containing 1
  ENST ID: ENST00000502703
  CDS Start-End: 249-570
aaggctttagttcaggagtggtgttaatgtattaatgtgttggggcgcgagaggaaggcggtgcttatttcgaatcatgtcttagagtttgaaagagtctatcttgataatctccccagtgcatccatgtatgagcgcagttacatgcatagagatgttatcacccatgtggtatgcaccaaacaatggaaggtaatacagagaatataggttttgtggtgtggtagattgaaagccactctagctatatggacctgagaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattt

SEQ ID NO: 164328 - DNA, 592 bp, Homo sapiens
  Payload ID: 12370
  Gene Symbol: PPWD1
  Gene Name: peptidylprolyl isomerase domain and WD repeat containing 1
  ENST ID: ENST00000503435
  CDS Start-End: 22-348
ttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaacaatggaaggtaatacagagaatataggttttgtggtgtggtagattgaaagccactctagctatatggacctgagaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactt

SEQ ID NO: 164329 - DNA, 2195 bp, Homo sapiens
  Payload ID: 12370
  Gene Symbol: PPWD1
  Gene Name: peptidylprolyl isomerase domain and WD repeat containing 1
  ENST ID: ENST00000535264
  CDS Start-End: 200-2050
agaagactgcgccgctgctttgggattggtagctgagttttgtgtcgcgccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagcagccacatgaagttggaatttcgaactcttatttagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctatttttt

SEQ ID NO: 164330 - DNA, 2055 bp, Homo sapiens
  Payload ID: 12370
  Gene Symbol: PPWD1
  Gene Name: peptidylprolyl isomerase domain and WD repeat containing 1
  Uniprot ID: Q96BP3
  ENST ID: ENST00000538977
  CDS Start-End: 438-1910
agaagactgcgccgctgctttgggattggtagctgagttttgtgtcgcgccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctatttttt

SEQ ID NO: 164331 - DNA, 1277 bp, Homo sapiens
  Payload ID: 12371
  Gene Symbol: PPIE
  Gene Name: peptidylprolyl isomerase E (cyclophilin E)
  Uniprot ID: Q9UNP9
  ENST ID: ENST00000324379
  CDS Start-End: 20-925
ggaaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctc

SEQ ID NO: 164332 - DNA, 1079 bp, Homo sapiens
  Payload ID: 12371
  Gene Symbol: PPIE
  Gene Name: peptidylprolyl isomerase E (cyclophilin E)
  Uniprot ID: Q9UNP9
  ENST ID: ENST00000356511
  CDS Start-End: 17-907
aaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaacca

SEQ ID NO: 164333 - DNA, 1198 bp, Homo sapiens
  Payload ID: 12371
  Gene Symbol: PPIE
  Gene Name: peptidylprolyl isomerase E (cyclophilin E)
  Uniprot ID: Q9UNP9
  ENST ID: ENST00000372830
  CDS Start-End: 1-945
atggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggttgccccagataccaaggcatcaaaagccaggggatccagaaaaaacaaagatggccaagagagaaactgggggaaaagccaaaaggttgagagccacaccatctagaagcttcctgcctgcggtgcggcacagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaacca

SEQ ID NO: 164334 - DNA, 842 bp, Homo sapiens
  Payload ID: 12371
  Gene Symbol: PPIE
  Gene Name: peptidylprolyl isomerase E (cyclophilin E)
  ENST ID: ENST00000372835
  CDS Start-End: 1-753
atggccaccaccaagcgcgtcttgtacgtgggtggactggcagaggaagtggacgacaaagttcttcatgctgcgttcattccttttggagacatcacagatattcagattcctctggattatgaaacagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtg

SEQ ID NO: 164335 - DNA, 927 bp, Homo sapiens
  Payload ID: 12371
  Gene Symbol: PPIE
  Gene Name: peptidylprolyl isomerase E (cyclophilin E)
  ENST ID: ENST00000470213
  CDS Start-End: 1-627
atggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggtatgtggccaggaatgggcctcctccttacccaggccctaggagcacagccctgtgtgagggctggagagtctctgtggcctgagagagatggccaggggctgtgtccagcgggaggggctgctgctgcccaggttccggggtggaagtgggcaaatgggcaggcaggggttggtatccctaaaccactgttagtctccggccttactccctc

SEQ ID NO: 164336 - DNA, 793 bp, Homo sapiens
  Payload ID: 12371
  Gene Symbol: PPIE
  Gene Name: peptidylprolyl isomerase E (cyclophilin E)
  ENST ID: ENST00000474804
  CDS Start-End: 1-114
gccaccaccaagcgcgtcttgtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatggtatggctgggaatcttaattctaactaaagttgctttttggtggtacagaggctccttattcatatatcagtgttctggacttccaaagttacaaggttgcatggggagaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccag

SEQ ID NO: 164337 - DNA, 913 bp, Homo sapiens
  Payload ID: 12371
  Gene Symbol: PPIE
  Gene Name: peptidylprolyl isomerase E (cyclophilin E)
  ENST ID: ENST00000497370
  CDS Start-End: 275-913
atggccaccaccaagcgcgtcttgtacgtggcatgctaactgggctgcaaggacttctgcaagagtatggagatcagtggctcagaaggcccttggcttatttgcaggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgag

SEQ ID NO: 164338 - DNA, 1213 bp, Homo sapiens
  Payload ID: 12371
  Gene Symbol: PPIE
  Gene Name: peptidylprolyl isomerase E (cyclophilin E)
  ENST ID: ENST00000475350
  CDS Start-End: 1-110
ccaccaagcgcgtcttgtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgcta

SEQ ID NO: 164339 - DNA, 4651 bp, Homo sapiens
  Payload ID: 12371
  Gene Symbol: PPIE
  Gene Name: peptidylprolyl isomerase E (cyclophilin E)
  ENST ID: ENST00000495526
  CDS Start-End: 14-130
gcgcgcgagcaagatggccaccaccaagcgcgtcttgtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatggtatggctgggaatcttaattctaactaaagttgctttttggtggtacagaggctccttattcatatatcagtgttctggacttccaaagttacaaggttgcatggggagaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcaggtgagcaggacgctgtggtcagaacggcgggacgctggtggctgagcagtgagcctttcccaggttcttactgcttcacttcttgtgtccttgatattgcttctgacctaagttgatttgaggcatctcagatcctgggatctagtaacagataagtcagagcaggtgtttttgaagctttataagtgctggcttactgttttttaatcgttttttaaaaatacaagtaaataatgtattcttttttttaaagaatagcatatacatatattccaataatatttaagacaataaattgaaaattcattttcccctctctacatccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttttatttccatgttgataacagttttatatttctacttcctgttttccattttaaacattatcttctgattttctacttcagagaacaaagaattagttttttaaaatccccttccctgccccctcatcttccctgtataggtaccataattttggttaggtcctaagttattttaacaatgtaagcatcatgtgataacctcctttcatgcacagcattttgttttgcctggaattgataattgccttgtttttgcatagttttctgtgtaatcattcctgattttctcccagaccatcctgctgggggttttgcatccaggtgtctgcatcttgttaaggggagatgagggcaaggctgaattcctcaacattcagtatataaactttcacataatctccatttgtcattatggtacctcagccctcactatgcgtaggatgtcctagtccagagaccctctgctttaacctaccaaagactagacccccagctggctaccaggttggggaggggtggcccccagctgcagagtcagggaaaggatcccaaagattaaccactttcttaaatgggctttcagccaaacttactgtctccaggattacctgcaccctttcctctgagcttttggagtgcaaattgagttgcttcttggcttttaccagcttaagattcagctttctcgggtctgctatatcatttaggactcatctattttgttttctaacttcagaaattttgttgctgttgtctcttcctccctgctttttaagtttattttttggctattttagccactttaaagtgtttgttagcagtaattactctgttcgaaatttttgaatcatcctaaacaaaaccacttattaaaggtacctattaaataataactccccattttctcctccccttagcttctgataacctctaatctttgtgtctatgaattggcctatcctagatttttcatgtaagtggaatcatacaatagctgtccttttccacgccttgttgattttgcatagcataatgctttcaaggttcatccttgtaccatgtatcagtgcctcattcctttttgtggctgaataatattccgttgtatttggataaatatcttgttcattcatttgttgatgggcacttgcacattgttttcaccttttgactattgtaaatgcctgtgtgaatatccacatgtaagtatatgtttaaattcctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccgggctggagtacagtggcgtgatattggctcactgcaacctccgcctcccaggttcaagtgattcttgtgcctcagcctcccgagtagctgggattacaggcgtctgccaccatgcccagccaattttttgtatttttagtagagacgaggtttcaccatgttggttggccaggctggtctcaaactcctgacctcatgattcgcctgcctcggcctcccatagtgctgggattacaggcgtgagccaccatgcctggcccacatcttctcttaacaggtgtgacatggcatctcattgtggtttttatttttattccctactgactaatgatgttgaacatcttttcatgtgcttgttgaccatttgtatatcttctttggagaaacatcttttcaaatctttggcttatttattaactggattgtttgttttgttttttttaagagacagggtcttgctctgactcccaggctggagtgcagtggtgagaacatggcttactgtagctttgaacccttgacctccagtgatcctcctgccttgacctcccaaagcactgggattacaccgtgcctggccattttgttgttgaattataggagttcattatatattctggatattaaacccatgttaaatatgatttgcaaataagcattctcctgttctgtgggttgctttgccctctattggtacggttctttgatgcacgtcttaaattttgataaaatctaattatttttttctttcacctctgcttttggtgtgacatttaagaaaccatcaccaaatccagagtcatgaagatttgcccctatgttttcttctaagatcctttggtttttcttttaaaaaatcagtttcctaccaatttagtgtggttttaaaagggaacagagctcgaacatgtatattcaatcccccttcaacagaatctcctatagtcctggccaggtgtggtggtttacacctgtaatcccagcactttgggaggccaaggtgggcggatcatctgaggtaggagttctagaccagcttggccaacatagtgaaaccccatctctactaaaaatacaaaattagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgcta

SEQ ID NO: 164340 - DNA, 947 bp, Homo sapiens
  Payload ID: 12371
  Gene Symbol: PPIE
  Gene Name: peptidylprolyl isomerase E (cyclophilin E)
  ENST ID: ENST00000470018
  CDS Start-End: 733-947
cctatgcctagccatggatcctccattccccaccctcccgttttcccgtcccgcagacggagccggtccccagccgccgccagtctccggcctcggatgttgacacaaacccgaggcggtttacactgagcgggtctggaagctttcagggccccggcaacacctcctccccgcacttgggggtctccccacagcccgggccggccgcctgggctgcactggcgtctgagagctcctgacacaaggctgtgggaaggaacccttttaagccaaactgggggcaaaaggggagccagacatccccgggctgggccacgtgcggggcagggacttctaaggatctgtcgaaagtcggggcggacggctggggattggcctaatcggagcgcggacgctgaagagcagcggcaccccagcctgctgtccatgtgcaggccaggaacccctgactgcctccatgctggcggcagcactttcccaagaacagaagcaggtgctgagtgagtgacccacgcgcctacgaaagaagagagggccagaagctggtgctgacgcagacaccaaggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctc

SEQ ID NO: 164341 - DNA, 2190 bp, Homo sapiens
  Payload ID: 12372
  Gene Symbol: PPIF
  Gene Name: peptidylprolyl isomerase F
  Uniprot ID: P30405
  ENST ID: ENST00000225174
  CDS Start-End: 72-695
tctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaatta

SEQ ID NO: 164342 - DNA, 821 bp, Homo sapiens
  Payload ID: 12372
  Gene Symbol: PPIF
  Gene Name: peptidylprolyl isomerase F
  ENST ID: ENST00000448165
  CDS Start-End: 1-497
cgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggtccatggcattggatgacattgcgctacactgttgctcacccgggtcacccgtcctcacaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccacccct

SEQ ID NO: 164343 - DNA, 761 bp, Homo sapiens
  Payload ID: 12372
  Gene Symbol: PPIF
  Gene Name: peptidylprolyl isomerase F
  ENST ID: ENST00000472580
  CDS Start-End: 81-518
actcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgagtgggggcctcctctagggtgagtgtccccacagctctgacctggcctggaagccccagcaggccctgagaggccacatgcagtcaccgtccagtatctgatgagtctccttcctccctgcgacactgtgtcctgtccatggctaatgctggtcctaacaccaacggctcccagttcttcatctgcaccataaagacagactggtccatggcattggatgacattgcgctacactgttgctcacccgggtcacccgtcctcacag

SEQ ID NO: 164344 - DNA, 6368 bp, Homo sapiens
  Payload ID: 12373
  Gene Symbol: PPIG
  Gene Name: peptidylprolyl isomerase G (cyclophilin G)
  Uniprot ID: Q13427
  ENST ID: ENST00000260970
  CDS Start-End: 221-2485
gcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacactttggtgtagtactgtgtgctgtgtttaactattttatgtatgcattactgtgttgcaacaattagccaatagcatcctaatttgtttagtcagccatttggaatggttgcaatgcattgttgcaaaagcttgtgtttctcatgattaaagtaactttagaagccactagaagacatcttgtatagattttctgattgcgttataaatagaggtttgcagcggtttcttttaattacacagaagcagggtcctaataacctgagatcttaaatcatcacttttgattttatagtaatttgtgctttaaaatagatgtatttatattgcacttcatactctattctttatagttcgagccatagcttgtttcctattaatgcttttcctgtctagttgtgttttacttaactgcctataaaaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaagcttttctcattaaaacataccatttgtgcaggtccttaagctatacagattctaaaaattgttagtattgagacattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggctatagcatgtttatgactctggtttctttctcttcaggtggttttataccattactgttaatgttattttaacttggcatgtataacattgccatatagagtagagtagaaagttgcaaattttgatagtttacagagttaaacactaaacatatccaaagtccatttagagttttgggtgttgtattttgccatttttgtgatgtgtggccttttattctgtaatctcttctaaataaaacattgaacatccagcaaacataaaacctgcctcatttgaaaaggaatttcaaaattccaattaataggattctctagagagttttgtactttaatatttgtcagtgtagtgtcaactctgttaccaaggtagcttcttggtaaatccagtagctactcaatgctatttgtactgaataaagcaattattaacatgatacttcccactattgattaatgcaatattgatatatttggcgttgtggtagctgttgcagaatgaatagtgtaatgaccataagattgcttggaaaattgtaatacagatatccacaatgaattctttccaaaatttttttttccgatgataaaagtagtagatgtttattataaaatccaaggtgattgattccttagagactgaccacaaacccacattagggataattgagtctgagtgcccaagctatataacgttatgtagtttaagcaagttattgtttgtcttaatttcagttaactgcattttaaaattgttgttataaactatttgagctttaagaaaggtgctatttaagaaaggatttctaataacagttaaatattttttttaagtccatgctaagtaaaaattcttacatgttgtctgatcccagagctttatctactaaaaattatacataaggatttccaaatcttagagtttcaaaaagtaaccatagggaaaaaaattgtagtaatttctataggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacctcaggatctgcgcatgcatctgaatagcacacggctcaaatggtcctttccttttgttacatttagtagttgtgccatctttagtttttgctttgaacattgttttcctaaaagtcaactattactttcccatcaagttggttttatagttatgtctaaatttatggttcatgtcaaagtatttttgacttaatatccttttaaaaatatttaaactgatttattgctcaattggtgatagctgagaaaattttttcaatatgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtagaagcttgttgggtttgccttcaccagaaggtactttaaatacctaccatagctgatttgttataaagaaacaaaatgggtgttcttctgtttccttttgattatgtttactgtaattatttcattttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagtattttgaaagataaatgaattgggtatttgtatgtgggatgtacaaaattgtggccgctctctttgtggaaggaaaaaacataaatgaagttaatgcacttcttttcctagcccaaaagtcactgtgattatatttttttaatgaagtttagaaaaaaagctgttgtcttctcaattgtaaaattagtttcaaaatgctgcttctcttatcattagtctagtaattgttgaacttttctgcaaactgcattttacaaaattgaaacttggaagctgtattaacttttatagttaaacattgtattaaataaactatactataataaa

SEQ ID NO: 164345 - DNA, 2615 bp, Homo sapiens
  Payload ID: 12373
  Gene Symbol: PPIG
  Gene Name: peptidylprolyl isomerase G (cyclophilin G)
  ENST ID: ENST00000409714
  CDS Start-End: 208-2427
gacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgc

SEQ ID NO: 164346 - DNA, 525 bp, Homo sapiens
  Payload ID: 12373
  Gene Symbol: PPIG
  Gene Name: peptidylprolyl isomerase G (cyclophilin G)
  ENST ID: ENST00000418888
  CDS Start-End: 349-525
gaagaggggcggagccggcgcggctgaccgggttgggtttaccgtctttccctcgaggtatcggggctgcttgggcccagaggaagtccctgaggaccgcagcagtgcctttgccgctgttgcagaaggagaaggcttgcagtcgagccccggggcctggggacggtccttcctctgccagcccccgccctccccactcaggcgcacacctccctcactgacgcattttgccgcacaagctgtaacatggcggcagcgactgcggcctgaactctagggagccgggttgatttttaaagcttcaaaatcctaagactcagcactgttgcgggattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacat

SEQ ID NO: 164347 - DNA, 1062 bp, Homo sapiens
  Payload ID: 12373
  Gene Symbol: PPIG
  Gene Name: peptidylprolyl isomerase G (cyclophilin G)
  ENST ID: ENST00000414307
  CDS Start-End: 323-1062
gaggaagtccctgaggaccgcagcagtgcctttgccgctgttgcagaaggagaaggcttgcagtcgagccccggggcctggggacggtccttcctctgccagcccccgccctccccactcaggcgcacacctccctcactgacgcattttgccgcacaagctgtaacatggcggcagcgactgcggcctgaactctagggagccgggttgatttttaaagcttcaaaatcctaagactcagcactgttgcggggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaa

SEQ ID NO: 164348 - DNA, 2498 bp, Homo sapiens
  Payload ID: 12373
  Gene Symbol: PPIG
  Gene Name: peptidylprolyl isomerase G (cyclophilin G)
  Uniprot ID: Q13427
  ENST ID: ENST00000448752
  CDS Start-End: 136-2400
tagatttgaagcgcttcaaaggaccggacccagagaagaggaaaactctaccggtgcaggtaagtggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgttttt

SEQ ID NO: 164349 - DNA, 1485 bp, Homo sapiens
  Payload ID: 12373
  Gene Symbol: PPIG
  Gene Name: peptidylprolyl isomerase G (cyclophilin G)
  ENST ID: ENST00000433207
  CDS Start-End: 24-1485
ttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatg

SEQ ID NO: 164350 - DNA, 527 bp, Homo sapiens
  Payload ID: 12373
  Gene Symbol: PPIG
  Gene Name: peptidylprolyl isomerase G (cyclophilin G)
  ENST ID: ENST00000417938
  CDS Start-End: 3-317
ccatgggaataaaggttcaacgtcctcgatgtttttttgacattgccattaacaatcaacctgctggaagagttgtctttgaattattttctgatgtgtgccccaaaacatgcgagaactttcgttgtctttgtacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatctt

SEQ ID NO: 164351 - DNA, 1516 bp, Homo sapiens
  Payload ID: 12373
  Gene Symbol: PPIG
  Gene Name: peptidylprolyl isomerase G (cyclophilin G)
  Uniprot ID: Q13427
  ENST ID: ENST00000462903
  CDS Start-End: 181-1254
gggagggaggcggttagcgggctttagcgccttttctggcggcggtagatttgaagcgcttcaaaggaccggacccagagaagaggaaaactctaccggtgcaggtaagtggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaagggtaggtgattctttccccagagatcttcacaatattgcatttgtcttccttaaataattttagggtgtttcttaaatattattttaatgtgcaagtaactaaaatttaggggagatgcaggcattgaattatatattctctttcttaagcagcttctgtatgttggtacttcccaacagaaaatccatgagatatgaatagattttacatttacatggtataaaatgggatcgaggtctttcttgtctcccgtgtttcttggcaatcactgtatctctattcttgttaaaaataaataaaaattaaccctattcttgta

SEQ ID NO: 164352 - DNA, 752 bp, Homo sapiens
  Payload ID: 12374
  Gene Symbol: PPIH
  Gene Name: peptidylprolyl isomerase H (cyclophilin H)
  Uniprot ID: O43447
  ENST ID: ENST00000304979
  CDS Start-End: 23-556
cttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgta

SEQ ID NO: 164353 - DNA, 327 bp, Homo sapiens
  Payload ID: 12374
  Gene Symbol: PPIH
  Gene Name: peptidylprolyl isomerase H (cyclophilin H)
  ENST ID: ENST00000372549
  CDS Start-End: 137-310
actagggaggcggaggtgggagataccgagcggcagggtggtgggtcagcccatcatgccccctgctccgtgaagccctcatggtcttggactgggccttctgacactctcccgctgattgcaggaagttggccgcatgaagatcgagctctttgcagacgttgtgcctaagacggccgagaactttaggcagttctgcaccggagaattcaggtcagtttcagatgtgtttgacttctttgcctgctccagaggggtgttctggggctgcagtgagggtatcggtgaaccacctgctggccttgaatgattgctggtgacagtgat

SEQ ID NO: 164354 - DNA, 665 bp, Homo sapiens
  Payload ID: 12374
  Gene Symbol: PPIH
  Gene Name: peptidylprolyl isomerase H (cyclophilin H)
  Uniprot ID: O43447
  ENST ID: ENST00000372550
  CDS Start-End: 240-644
gcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcag

SEQ ID NO: 164355 - DNA, 669 bp, Homo sapiens
  Payload ID: 12374
  Gene Symbol: PPIH
  Gene Name: peptidylprolyl isomerase H (cyclophilin H)
  ENST ID: ENST00000440068
  CDS Start-End: 236-669
ggtgagatccaggaggctgcccacacctgcgccgaagggaaactgctcggggctaggcaggcagaactcacccagagagagcggactcgggaagccagccagaaagtgaaattgcacccgaacctaccgacctgccgggcggggggaaaggaggaggaggagtctccccaatcctagcgccccgcttctggaggaactgggcggttagactagggaggcggaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgat

SEQ ID NO: 164356 - DNA, 416 bp, Homo sapiens
  Payload ID: 12374
  Gene Symbol: PPIH
  Gene Name: peptidylprolyl isomerase H (cyclophilin H)
  ENST ID: ENST00000436387
  CDS Start-End: 213-416
aattcaggtcagtttcagatgtgtttgacttctttgcctgctccagaggggtgttctggggctgcagtgagggtatcggtgaaccacctgctggccttgaatgattgctggtgacagtgatagaaggtaatgccccaagggtctgtccctagtttatttgccttctttatgtctgtcaaccatctttaggagagtccttttggctccagtgcatggtaaactggaaaggccttgtgctacctgctgtcactccaagtctctttcttttcggttataggaaagatggggttccaataggatacaaaggaagcaccttccacagggtcataaaggatttcatgattcagggtggagattttgttaatgtaagtactattcctttcctatcaaagacccgtagttttagtttttgttgt

SEQ ID NO: 164357 - DNA, 527 bp, Homo sapiens
  Payload ID: 12374
  Gene Symbol: PPIH
  Gene Name: peptidylprolyl isomerase H (cyclophilin H)
  ENST ID: ENST00000461351
  CDS Start-End: 1-291
ggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcagcacttcccaggagcctgcccacagctgtggctaacatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgta

SEQ ID NO: 164358 - DNA, 1570 bp, Homo sapiens
  Payload ID: 12375
  Gene Symbol: PTRH1
  Gene Name: peptidyl-tRNA hydrolase 1 homolog
  ENST ID: ENST00000423807
  CDS Start-End: 365-913
gggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtccatttctggagtaggttcttctctctgtgtcctacttgggacgtaggggaacttcaggaagactaaacttttcaagcctttttagagaaccaggggcacgcatctgtaagattaaagatgctggcttggaggccgggtgcagtggctcacacctataatcccagcactttgggaggccgaggctgggggattgcttgacgtcaggagttcgagaccagcctggccaacatggtgaaaccctgtctctactaaaaatacaaaaagtagccaggcatggtggtgcatgcctgtaatccctgctacttgggagactgaggcaggagaatcacttgaacctgggaggcggaggttgctgtgagctgagattgtggcactgcactccagtctgggtgacagagtgagactctgtctcaaaaaaaaaaaaaaaaaaaaaaaaaaaagaaa

SEQ ID NO: 164359 - DNA, 2692 bp, Homo sapiens
  Payload ID: 12375
  Gene Symbol: PTRH1
  Gene Name: peptidyl-tRNA hydrolase 1 homolog
  Uniprot ID: Q86Y79
  ENST ID: ENST00000419060
  CDS Start-End: 1458-2102
atcttctcctgcagcaggcccatgcgcgtgttggcgccctcgtcctgagggctcagcgccagcgcctgctggtagtccgcctcggcaaaggccaggttgcccagctggaagaagcaatctagggtccggaggcggggatgctttggaacacgtggctggtcccaaagatgtgctgcaggatccctttgggggctggaatcacccatggctttgggatgtcccgtgaggggccctggtcaaccttcagggcatcctagaaccgaaggacagcaagctggagcaggcccccgagacgacccccacccactgacacactccccagcattctgcagggagggaggagaggcggaaatgaggcctggaaggaggcactcccactcggggttccggtggcgctcccagccccattccccttagggacgctccaacctgtccctctgcagtcctgcccttctccctctcctgtggtcaaggtcagggatcagggtcctcatgcttacaacaccgtctgttctcccccagggccttcccagctcccacttccggctactgacaccccaagctttgatgtctccagctcaggcctggtcccaagtctcaggccttgggggtcctacagtcccttgggtaaccttcaggaccctcactccagcaggccacactgagcacctcacctgacttctgccccaggttctcccattttggtgaggtcaccttccccaccagctacccaagccagagacctctgtccaagcagccgccgagccttacaaggatctttcacatgcctggttcttggcatggcggccagggccttccctgagtcggactgctgcccctgcctctcccggccttcaccctttcctgcgaacccagcctcggtctctctgcctggccctctgcctttgcgttagtcttctcccaagcccgcacctcgtccgaatctgtcatgaggccccttccaggaggaccccgaggcctctgccaactacctcgcggccctggccctgacgttgctaggcaccatcaccaggacgcccacaggccccacccctctggccacgcccccgggaaccaagctttttgagccggagggaggtagaaaacttttattagctggagaggttgaggcctacagcggggaaaggacttgccagattttcgccgcaagtcagggccatagcggggggcataacaaggcctcccaaccgaaggtcaagcaagagctccgagcgtcccacacaagtcccgaagggacactgtgacgccgcgctactgaaggcgcctgggttcccggactcggccaccgcctcgccgcttccgcccctcagaagcatggcggccacgtagcccggcccggattggacgttggcggtggacgccaaacagttggcaacacgattggctgctgcggggtgatgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgactggaccagtccatttctggagtaggttcttctctctgtgtcctacttgggacgtaggggaacttcaggaagactaaacttttcaagcctttttagagaaccaggggcacgcatctgtaagattaaagatgctggcttggaggccgggtgcagtggctcacacctataatcccagcactttgggaggccgaggctgggggattgcttgacgtcaggagttcgagaccagcctggccaacatggtgaaaccctgtctctactaaaaatacaaaaagtagccaggcatggtggtgcatgcctgtaatccctgctacttgggagactgaggcaggagaatcacttgaacctgggaggcggaggttgctgtgagctgagattgtggcactgcactccagtctgggtgacagagtgagactctgtctcaaaaaaaaaaaaaaa

SEQ ID NO: 164360 - DNA, 814 bp, Homo sapiens
  Payload ID: 12375
  Gene Symbol: PTRH1
  Gene Name: peptidyl-tRNA hydrolase 1 homolog
  Uniprot ID: Q86Y79
  ENST ID: ENST00000543175
  CDS Start-End: 19-663
ggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtg

SEQ ID NO: 164361 - DNA, 645 bp, Homo sapiens
  Payload ID: 12375
  Gene Symbol: PTRH1
  Gene Name: peptidyl-tRNA hydrolase 1 homolog
  ENST ID: ENST00000456267
  CDS Start-End: 1-517
gctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgc

SEQ ID NO: 164362 - DNA, 424 bp, Homo sapiens
  Payload ID: 12375
  Gene Symbol: PTRH1
  Gene Name: peptidyl-tRNA hydrolase 1 homolog
  ENST ID: ENST00000416214
  CDS Start-End: 13-424
aatgggggcagcatgaggccgggcggctttttgggcgccggacagcggctgagtagagccatgagccgatgtgttttggagcctcgccccccggggaagcggtggatgtttccctggtgccgcccgcaggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactgg

SEQ ID NO: 164363 - DNA, 569 bp, Homo sapiens
  Payload ID: 12375
  Gene Symbol: PTRH1
  Gene Name: peptidyl-tRNA hydrolase 1 homolog
  ENST ID: ENST00000414832
  CDS Start-End: 1-487
gggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgta

SEQ ID NO: 164364 - DNA, 901 bp, Homo sapiens
  Payload ID: 12376
  Gene Symbol: PTRH2
  Gene Name: peptidyl-tRNA hydrolase 2
  Uniprot ID: Q9Y3E5
  ENST ID: ENST00000393038
  CDS Start-End: 229-768
atacgttcctccctcctttcggcgagctcggttgatcctcgcgggatttcagttaggctcttagtgcgggccctgtgggtgtggcaagaggaagaatgactgctcgctttgtgattcttgatccggaacttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttcta

SEQ ID NO: 164365 - DNA, 2246 bp, Homo sapiens
  Payload ID: 12376
  Gene Symbol: PTRH2
  Gene Name: peptidyl-tRNA hydrolase 2
  ENST ID: ENST00000409433
  CDS Start-End: 1573-2115
ctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaacttgtcacccaggaaccccggaagaggtagctcacgcgatagaaacgtgttcgctgcccagaagaagggaaggcgcgagtgaggaaaggaggtactgtagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttaagggataagaagcaaatcagtgatgcagcgaaatcgtcagcatcagttaaatccactgtcatcacaaagaaaagggctggaccaattgatgatatggaaaaattacttgttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcacgtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggcagaggcatttgctgctatcagcagtggcctacacgttagaagaaatggacgtcaattacgagagattcgccacagttgacaggcgcagatacaggatgctcttgcttgctacagagaaatatatagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattaatgatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttc

SEQ ID NO: 164366 - DNA, 4114 bp, Homo sapiens
  Payload ID: 12376
  Gene Symbol: PTRH2
  Gene Name: peptidyl-tRNA hydrolase 2
  Uniprot ID: Q9Y3E5
  ENST ID: ENST00000470557
  CDS Start-End: 3448-3987
aaatcaaaaccctatgcatcgctctaagtctttccagtttactttcattacacctgttcttcaacagcatgtctagataaatagcatgcatcactttattgtccataaatcagtctttgataatacaggttgctttttatcaggtaggccaaaagagaaaaatgtaataacacaggttgcatggtctatcatgtcaaacattcttacccttatcctaaattcccttgtaccactgtgtcttggggcgtgctcctggcataatttaaacttggatacatccaactaccatttcagtaggaggggagagcaaaggatgagtgtggatggaggttagtttgtatgtctggaggaagtgattagtagttttagtcttttggcttctaagtactactggagaaaatcacaaatagtatgttgccattaaaaagtcatcattaatcttaaccatgctttcaatattcctctgcaatcctgccatattttgccacaccttttatttccgcctttctcttctctactccattttaacttctgtctgagctccttccctcagggggaatactttcctgccttcaaatccgtggacctacttgatttaaaactgaaattgggaaaggtgtcccttttcctttccaaaaccacatccctttataaagtctttctctatcttgagcatttacctgcctttcttctggcttcatcctattaacatttaaatatgcttatcctttcttcttaggagaaaaaaaaaattgctttcctctgtgtcgccttatatccattgctttttctttttgctctatctcttgaccccacctcaaacgaatttctgccccaccaaagacagtaaccccttttatgttaaaattagtggaaagaatgttaatataatgccctaactttaaagaagaacataaaggaaatttataagtacttccagggctgtcatctatgccgtgccaatcatgcagtgcacaattccaagggcaccactttacattacaaatacagtgcattacaaatatagtggccccatgtttataaatgcttagataatactccactagaaaaagaaactgatagttgcttgccacatagaagcactgtgaatccagcagcctcatttgtagactgatataagtgtcttattggtgactcaaatattatgaacagctttgccgaagtagcaagattttctaaaataataaaggatgacattcctttgttttatgatagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttaagggataagaagcaaatcagtgatgcagcgaaatcgtcagcatcagttaaatccactgtcatcacaaagaaaagggctggaccaattgatgatatggaaaaattacttgttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcacgtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggcagaggcatttgctgctatcagcagtggcctacacgttagaagaaatggacgtcaattacgagagattcgccacagttgacaggcgcagatacaggatgctcttgcttgctacagagaaatatatagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattaatggtgagtacccatacaaccattgttttccacttacagtattcaataaattacaggagatattcaacactattataaaagagcctcgtgttagatgatttttgtccaactgtaggctaatgtaagtgttctgagcacatttaaggtaggctaggctaagtcatgatattctgtaggtgtattaaatgcatttttggcttacagtattttcaattaattgggttaattgggatataaccccatggaaaattgaggagcacctgtacatagtaaaactatgcaaaaaatattttgtgttcttaagtaaaatgatgttgagttctcatctcagttattaagtttttcagctgcactcacgtccaatgggacaactcttcattttgtaaggtttttagcatccttgctcaggcttagtaaatttcagtagtgcacctcactccaggcccattaatgtgacagtgaggttcttctgagggtaactgatttgataccatctccactgagaaccactgcattgtgaaaacaccgattagcactgtattccaggaaagggttatttttggtttctttaaatcttaggcatcttggtaaaacggaacatctccacaagactaagggaagactgaggaatagagtttttgaactttatgcaacttcgtttacatcaagattcaaaatgacctaaactgtttcatgtggatgcttgaatcttttctagtacactggtggtgggcaagagggtgttggaaacagggtgcaggcataagatcaaaggtgtgttttgccttttttctggatgaccattaagtgtatagtcaaaatgtttctctgataagcctatacctctgtaagttgttactgccggatagtgataactgttttcctttcctttaagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccat

SEQ ID NO: 164367 - DNA, 1105 bp, Homo sapiens
  Payload ID: 12377
  Gene Symbol: PTRHD1
  Gene Name: peptidyl-tRNA hydrolase domain containing 1
  Uniprot ID: Q6GMV3
  ENST ID: ENST00000328379
  CDS Start-End: 6-428
ccaagatgcaccggggagtaggtccggcctttcgggtggtcaggaagatggcggcctctggggcggagccgcaggtcctggtacaatacttggtgttacgaaaggatctatcacaagctccgttctcctggccggcgggcgcactggtagcgcaggcttgtcacgcggccaccgcggccttgcacactcaccgcgaccacccgcacacagccgcttacctccaagagctggggcgcatgcgcaaagtggtcctcgaggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagt

SEQ ID NO: 164368 - DNA, 2492 bp, Homo sapiens
  Payload ID: 12378
  Gene Symbol: PRF1
  Gene Name: perforin 1 (pore forming protein)
  Uniprot ID: P14222
  ENST ID: ENST00000373209
  CDS Start-End: 120-1787
tggctggtgcaaggagccacagtgggctgcctggggggctgatgccaccattccaggagcctcggtgaagagaggatatccatctgtgtagccgcttctctatacgggattccagctccatggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtgagaacagtgagcttggaaaggaccagtatgcttggactgaaggggttctcacagtgggagccagggctgtcttcgtattcccattagaccaagcttgtccaacccgaggcccgcatgcggcccaggatggctttgaatgcggcccaacgcaaattcgcaaactttcttaaaacattatgagtttctttttgctattttttttttttttttagctcatcggctatcgttagtgctagtggattttacatgtggcccaacacaattcttcttccaacgtggcccagagaagccaaaagattggatacgcatcagacagatggaaaagggagattcagactgtttttcagggaggtggctgggtttacacgctaatcccgattcaccctgtccaaactgcctaagccctccgccattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctttgcccacaatgctttgcccctgagacaaatggaggcctgtcctgacctgtctcaccatgtacatagcttgataaagggccaataaatatgatgttatggtga

SEQ ID NO: 164369 - DNA, 2533 bp, Homo sapiens
  Payload ID: 12378
  Gene Symbol: PRF1
  Gene Name: perforin 1 (pore forming protein)
  Uniprot ID: P14222
  ENST ID: ENST00000441259
  CDS Start-End: 162-1829
gaagtgatgtgagtggtggctggtgcaaggagccacagtgggctgcctggggggctgatgccaccattccaggagcctcggtgaagagaggatatccatctgtgtagccgcttctctatacgggattccagagcccaagtgccccctgtctctgcagctccatggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtgagaacagtgagcttggaaaggaccagtatgcttggactgaaggggttctcacagtgggagccagggctgtcttcgtattcccattagaccaagcttgtccaacccgaggcccgcatgcggcccaggatggctttgaatgcggcccaacgcaaattcgcaaactttcttaaaacattatgagtttctttttgctattttttttttttttttagctcatcggctatcgttagtgctagtggattttacatgtggcccaacacaattcttcttccaacgtggcccagagaagccaaaagattggatacgcatcagacagatggaaaagggagattcagactgtttttcagggaggtggctgggtttacacgctaatcccgattcaccctgtccaaactgcctaagccctccgccattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctttgcccacaatgctttgcccctgagacaaatggaggcctgtcctgacctgtctcaccatgtacatagcttgataaagggccaataaatatgatgttatggtg

SEQ ID NO: 164370 - DNA, 5502 bp, Homo sapiens
  Payload ID: 12379
  Gene Symbol: PRX
  Gene Name: periaxin
  Uniprot ID: Q9BXM0
  ENST ID: ENST00000291825
  CDS Start-End: 270-713
gctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctggtacgcgtgcttagcccggccccggccctggactgccccagcgatccggtctctgcgccgtgagccccattccccgccatcgtgggccagccttgccctctgtcttgtcactaacccaagctaattccaccctctgccccttcctctctgccccaaactcttccccgggaagggggacagacccaccccagcccagggccctcacccacctcggagaggcgtccccaccatcggatccaggcttgctaggggtcctgaaccaggctacttcgaaccaggaaagccagattccagcctgagtgctggcccaattactgctgagtggccctggacaaagttgtttctctccctgggcctcagtttccccatctctagaatgaggatgttggggaaaatcccggatcaggatctagaagtcttgggtccccgtccctacactcctgttgactcatttggagatcctagatggctgcctgctttcctgggcactcatggtgaaatgacaggcaagaagtggggatgatgtttggggaacaagatacttgacccagcacatcccccgcctggtccaataccaggtggggctcttcctgtccactcccagcctcccactgtcccaccgcctcctgcctctctcctctctccccagaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaagatgccttcctttgggctggctcgagggaaggaagcagaagttcaaggtgatcgtgccagcccgggggaaaaggctgagtccaccgctgtgcagcttaagatccccgaggtggagctggtcacgctgggcgcccaggaggaagggagggcagagggggctgtggccgtcagtggaatgcagctgtcaggcctgaaggtgtccacagccgggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggctgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagta

SEQ ID NO: 164371 - DNA, 4855 bp, Homo sapiens
  Payload ID: 12379
  Gene Symbol: PRX
  Gene Name: periaxin
  Uniprot ID: Q9BXM0
  ENST ID: ENST00000324001
  CDS Start-End: 272-4657
gagctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctgaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaagatgccttcctttgggctggctcgagggaaggaagcagaagttcaaggtgatcgtgccagcccgggggaaaaggctgagtccaccgctgtgcagcttaagatccccgaggtggagctggtcacgctgggcgcccaggaggaagggagggcagagggggctgtggccgtcagtggaatgcagctgtcaggcctgaaggtgtccacagccgggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggctgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagta

SEQ ID NO: 164372 - DNA, 10560 bp, Homo sapiens
  Payload ID: 12380
  Gene Symbol: PCNT
  Gene Name: pericentrin
  Uniprot ID: O95613
  ENST ID: ENST00000359568
  CDS Start-End: 108-10118
gcggggggagggcgagcccaagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacagtcagtgaccacccaccagaacagcatgggatgttcacagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtatgggaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagtttgagcttcgagaagctgaaatgaggcagcttcaggaccaacaggcagcccagatcctggatctggagaggtccttgacggagcagcagggccgcctgcagcagctggaacaggacctcacttcagacgacgccctgcattgcagccagtgtgggcgggagccgcccacagcccaggacggggagcttgctgcgctccacgtgaaggaagactgcgccctgcagctgatgctggcccggagcaggtttttagaggaacgtaaagagatcaccgagaaattcagtgcggaacaagatgccttcctgcaggaggcccaggagcagcatgcccgtgagctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagacaaaacacgctgccgacctcggcgctctggagaccagacatctgtccagccttgattctttggaatcctgttacctctctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagtgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaaattcattctcgttttgaaaaagaatttagttttaagaatgaggagacagcacaggttgtcaggaagcaccaggagctgctggagtgtttgaaggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcgcagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctgcgagaattagaactgcagcgtcagcgtgacttgcataagatcaagcagcttcagcagacagtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 164373 - DNA, 796 bp, Homo sapiens
  Payload ID: 12380
  Gene Symbol: PCNT
  Gene Name: pericentrin
  ENST ID: ENST00000418394
  CDS Start-End: 1-686
aggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcg

SEQ ID NO: 164374 - DNA, 6820 bp, Homo sapiens
  Payload ID: 12381
  Gene Symbol: PCM1
  Gene Name: pericentriolar material 1
  Uniprot ID: Q15154
  ENST ID: ENST00000325083
  CDS Start-End: 440-6514
tccggcgggtcacatgactccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatcta

SEQ ID NO: 164375 - DNA, 8287 bp, Homo sapiens
  Payload ID: 12381
  Gene Symbol: PCM1
  Gene Name: pericentriolar material 1
  ENST ID: ENST00000327578
  CDS Start-End: 423-6005
ctccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaaaagtgattgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaaaaaaaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtat

SEQ ID NO: 164376 - DNA, 2171 bp, Homo sapiens
  Payload ID: 12381
  Gene Symbol: PCM1
  Gene Name: pericentriolar material 1
  ENST ID: ENST00000518537
  CDS Start-End: 281-1873
ctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgctagagaaaatgaggaggaggatgttcggactatagattcagctgtgggatctggttctgtagctgagagcacatcgctaaacatagatgtgcagtctgaggcttcagataccacggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaa

SEQ ID NO: 164377 - DNA, 2536 bp, Homo sapiens
  Payload ID: 12381
  Gene Symbol: PCM1
  Gene Name: pericentriolar material 1
  ENST ID: ENST00000517730
  CDS Start-End: 290-2536
aatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgctagagaaaatgaggaggaggatgttcggactatagattcagctgtgggatctggttctgtagctgagagcacatcgctaaacatagatgtgcagtctgaggcttcagataccacggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattca

SEQ ID NO: 164378 - DNA, 2379 bp, Homo sapiens
  Payload ID: 12381
  Gene Symbol: PCM1
  Gene Name: pericentriolar material 1
  ENST ID: ENST00000522275
  CDS Start-End: 1-2294
gaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtat

SEQ ID NO: 164379 - DNA, 1426 bp, Homo sapiens
  Payload ID: 12381
  Gene Symbol: PCM1
  Gene Name: pericentriolar material 1
  ENST ID: ENST00000523055
  CDS Start-End: 202-1426
gtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaa

SEQ ID NO: 164380 - DNA, 5955 bp, Homo sapiens
  Payload ID: 12381
  Gene Symbol: PCM1
  Gene Name: pericentriolar material 1
  ENST ID: ENST00000524226
  CDS Start-End: 60-5642
agcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagta

SEQ ID NO: 164381 - DNA, 6443 bp, Homo sapiens
  Payload ID: 12381
  Gene Symbol: PCM1
  Gene Name: pericentriolar material 1
  ENST ID: ENST00000519253
  CDS Start-End: 252-6302
gctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctcccca

SEQ ID NO: 164382 - DNA, 2953 bp, Homo sapiens
  Payload ID: 12382
  Gene Symbol: PLIN1
  Gene Name: perilipin 1
  Uniprot ID: O60240
  ENST ID: ENST00000300055
  CDS Start-End: 167-1735
caggagtgacaggaattgtttctgcctgaggagacactctgcagcctgggctctgtgagactgaggtggcggtcagccggagtgagtgttggggtcctggggcacctgccttacatggcttgtttatgaacattaaagggaagaagttgaagcttgaggagcgaggatggcagtcaacaaaggcctcaccttgctggatggagacctccctgagcaggagaatgtgctgcagcgggtcctgcagctgccggtggtgagtggcacctgcgaatgcttccagaagacctacaccagcactaaggaagcccaccccctggtggcctctgtgtgcaatgcctatgagaagggcgtgcagagcgccagtagcttggctgcctggagcatggagccggtggtccgcaggctgtccacccagttcacagctgccaatgagctggcctgccgaggcttggaccacctggaggaaaagatccccgccctccagtacccccctgaaaagattgcttctgagctgaaggacaccatctccacccgcctccgcagtgccagaaacagcatcagcgttcccatcgcgagcacttcagacaaggtcctgggggccgctttggccgggtgcgagcttgcctggggggtggccagagacactgcggaatttgctgccaacactcgagctggccgactggcttctggaggggccgacttggccttgggcagcattgagaaggtggtggagtacctcctccctccagacaaggaagagtcagcccctgctcctggacaccagcaagcccagaagtctcccaaggccaagccaagcctcttgagcagggttggggctctgaccaacaccctctctcgatacaccgtgcagaccatggcccgggccctggagcagggccacaccgtggccatgtggatcccaggcgtggtgcccctgagcagcctggcccagtggggtgcctcagtggccatgcaggcggtgtcccggcggaggagcgaagtgcgggtaccctggctgcacagcctcgcagccgcccaggaggaggatcatgaggaccagacagacacggagggagaggacacggaggaggaggaagaattggagactgaggagaacaagttcagtgaggtagcagccctgccaggccctcgaggcctcctgggtggtgtggcacataccctgcagaagaccctccagaccaccatctcggctgtgacatgggcacctgcagctgtgctgggcatggcagggagggtgctgcacctcacaccagcccctgctgtctcctcaaccaaggggagggccatgtccctatcagatgccctgaagggcgttactgacaacgtggtggacacagtggtgcattacgtgccgctccccaggctgtcgctgatggagcccgagagcgaattccgggacatcgacaacccaccagccgaggtcgagcgccgggaggcggagcgcagagcgtctggggcgccgtccgccggcccggagcccgccccgcgtctcgcacagccccgccgcagcctgcgcagcgcgcagagccccggcgcgccccccggcccgggcctggaggacgaagtcgccacgcccgcagcgccgcgcccgggcttcccggccgtgccccgcgagaagccaaagcgcagggtcagcgacagcttcttccggcccagcgtcatggagcccatcctgggccgcacgcattacagccagctgcgcaagaagagctgagtcgccgcaccagccgccgcgccccgggccggcgggtttctctaacaaataaacagaacccgcactgcccaggcgagcgttgccactttcaaagtggtcccctggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctgatgaacatcctctgatgatctaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatcaaaaatg

SEQ ID NO: 164383 - DNA, 2900 bp, Homo sapiens
  Payload ID: 12382
  Gene Symbol: PLIN1
  Gene Name: perilipin 1
  Uniprot ID: O60240
  ENST ID: ENST00000430628
  CDS Start-End: 121-1689
tggaagcagcattgcccaagcctcccaggagtgacaggaattgtttctgcctgaggagacactctgcagcctgggctctgtgagactgaggtggcggtcagccggacttgaggagcgaggatggcagtcaacaaaggcctcaccttgctggatggagacctccctgagcaggagaatgtgctgcagcgggtcctgcagctgccggtggtgagtggcacctgcgaatgcttccagaagacctacaccagcactaaggaagcccaccccctggtggcctctgtgtgcaatgcctatgagaagggcgtgcagagcgccagtagcttggctgcctggagcatggagccggtggtccgcaggctgtccacccagttcacagctgccaatgagctggcctgccgaggcttggaccacctggaggaaaagatccccgccctccagtacccccctgaaaagattgcttctgagctgaaggacaccatctccacccgcctccgcagtgccagaaacagcatcagcgttcccatcgcgagcacttcagacaaggtcctgggggccgctttggccgggtgcgagcttgcctggggggtggccagagacactgcggaatttgctgccaacactcgagctggccgactggcttctggaggggccgacttggccttgggcagcattgagaaggtggtggagtacctcctccctccagacaaggaagagtcagcccctgctcctggacaccagcaagcccagaagtctcccaaggccaagccaagcctcttgagcagggttggggctctgaccaacaccctctctcgatacaccgtgcagaccatggcccgggccctggagcagggccacaccgtggccatgtggatcccaggcgtggtgcccctgagcagcctggcccagtggggtgcctcagtggccatgcaggcggtgtcccggcggaggagcgaagtgcgggtaccctggctgcacagcctcgcagccgcccaggaggaggatcatgaggaccagacagacacggagggagaggacacggaggaggaggaagaattggagactgaggagaacaagttcagtgaggtagcagccctgccaggccctcgaggcctcctgggtggtgtggcacataccctgcagaagaccctccagaccaccatctcggctgtgacatgggcacctgcagctgtgctgggcatggcagggagggtgctgcacctcacaccagcccctgctgtctcctcaaccaaggggagggccatgtccctatcagatgccctgaagggcgttactgacaacgtggtggacacagtggtgcattacgtgccgctccccaggctgtcgctgatggagcccgagagcgaattccgggacatcgacaacccaccagccgaggtcgagcgccgggaggcggagcgcagagcgtctggggcgccgtccgccggcccggagcccgccccgcgtctcgcacagccccgccgcagcctgcgcagcgcgcagagccccggcgcgccccccggcccgggcctggaggacgaagtcgccacgcccgcagcgccgcgcccgggcttcccggccgtgccccgcgagaagccaaagcgcagggtcagcgacagcttcttccggcccagcgtcatggagcccatcctgggccgcacgcattacagccagctgcgcaagaagagctgagtcgccgcaccagccgccgcgccccgggccggcgggtttctctaacaaataaacagaacccgcactgcccaggcgagcgttgccactttcaaagtggtcccctggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctgatgaacatcctctgatgatctaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatc

SEQ ID NO: 164384 - DNA, 698 bp, Homo sapiens
  Payload ID: 12382
  Gene Symbol: PLIN1
  Gene Name: perilipin 1
  ENST ID: ENST00000560330
  CDS Start-End: 1-222
gaggaagaattggagactgaggagaacaagttcagtgaggtagcagccctgccaggccctcgaggcctcctgggtggtgtggcacataccctgcagaagaccctccagaccaccatctcggctctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatcaaaaa

SEQ ID NO: 164385 - DNA, 1972 bp, Homo sapiens
  Payload ID: 12383
  Gene Symbol: PLIN2
  Gene Name: perilipin 2
  Uniprot ID: Q99541
  ENST ID: ENST00000276914
  CDS Start-End: 181-1494
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggata

SEQ ID NO: 164386 - DNA, 655 bp, Homo sapiens
  Payload ID: 12383
  Gene Symbol: PLIN2
  Gene Name: perilipin 2
  ENST ID: ENST00000380464
  CDS Start-End: 95-427
tttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcaggtgagcttgggacaaaagtgctgagacttgacacttcacatgttttcatcttctatctgttaaaacaagctgtacatatcacaaacaggcaaatacttgttttcccaacctggatctggatgtatgtttgaaaaataatggccacttccttacttcctgaactgttgtcaagttgtatctacgaagcagagaagaactagcctcctttggattagaaaacttttagtgtgttgtctatcagtttgtgtcttt

SEQ ID NO: 164387 - DNA, 631 bp, Homo sapiens
  Payload ID: 12383
  Gene Symbol: PLIN2
  Gene Name: perilipin 2
  ENST ID: ENST00000380465
  CDS Start-End: 81-461
ggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcaggcaaatacttgttttcccaacctggatctggatgtatgtttgaaaaataatggccacttccttacttcctgaactgttgtcaagttgtatctacgaagcagagaagaactagcctcctttggattagaaaacttttagtgtgttgtctatcagtttgtgtctttgctcctataaatgaaattgctgtctcaagtaactgattgtcttgtggtattaaataaatgcagacgtgatatatataa

SEQ ID NO: 164388 - DNA, 623 bp, Homo sapiens
  Payload ID: 12383
  Gene Symbol: PLIN2
  Gene Name: perilipin 2
  ENST ID: ENST00000434144
  CDS Start-End: 249-623
cagaacgttttgtcagaacaattatggctttcttcctgaagtgtgcttggccggaaaagaaagcaggagacctcaagggctaataatctagcagtggctgacactgaaatgatgcatggaagaaaggctaccaagcaagggaggtggagagcagtttgaagcaactggggtaaagtccggagaagaagctggtgagaaagagacaggagccagatgctgaatgacgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggg

SEQ ID NO: 164389 - DNA, 2333 bp, Homo sapiens
  Payload ID: 12384
  Gene Symbol: PLIN3
  Gene Name: perilipin 3
  Uniprot ID: O60664
  ENST ID: ENST00000221957
  CDS Start-End: 178-1482
tggcgcgggcaatccctcaacctgattggtcccctcgcccgtcactccagtgcgcccccaacctaccacgcagtaaaagccacccccgcctcggcccggacggtttccaagctggttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 164390 - DNA, 604 bp, Homo sapiens
  Payload ID: 12384
  Gene Symbol: PLIN3
  Gene Name: perilipin 3
  ENST ID: ENST00000587462
  CDS Start-End: 498-604
attctggggaggtcttgggcaaagcctgcccacttccctcgggtgggcgtggcgacgaggtggcttaaaagtaggaaggcctatccgttaactgctttggggttcttgtcccggctaggcctggcagtgggacctggggcccttggaattttggaagtccagtcttagcatgctctgaagttgctggatggctgggtctggcctggagctccccttctggagccagcggcaaggcaggtcactgacccccaggggtttcatagggtgttgacatctgccatggccacccttgcttaaaccagttccaggaagtcatggtggacagaggggacgggaggaagctgcctgagtcctaagtgggacttgagaatcggtcgaggccaggagtttgatgcctgcctacctggccccctgcccaggtgagctcaggctccaaaggaggtgaggagaagcacagatttaggcaatgatcactgggagcgtctgctgcagagaccatgtctgccgacggggcagaggctgatggcagcacccaggtgacagtggaagaaccggtacagcagcccagtgtggtggaccgtgtggccagcatgcctctgatcag

SEQ ID NO: 164391 - DNA, 1535 bp, Homo sapiens
  Payload ID: 12384
  Gene Symbol: PLIN3
  Gene Name: perilipin 3
  Uniprot ID: O60664
  ENST ID: ENST00000585479
  CDS Start-End: 104-1405
aaaagccacccccgcctcggcccggacggtttccaagctggttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctgatggaaactgtcaagcaaggcgttgatcagaagctggtggaaggccaggagaagctgcaccagatgtggctcagctggaaccagaagcagctccagggccccgagaaggagccgcccaagccagaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttggga

SEQ ID NO: 164392 - DNA, 574 bp, Homo sapiens
  Payload ID: 12384
  Gene Symbol: PLIN3
  Gene Name: perilipin 3
  ENST ID: ENST00000589034
  CDS Start-End: 57-574
gctgttcctgggacgtccggttgaccgcgcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacct

SEQ ID NO: 164393 - DNA, 2154 bp, Homo sapiens
  Payload ID: 12384
  Gene Symbol: PLIN3
  Gene Name: perilipin 3
  Uniprot ID: O60664
  ENST ID: ENST00000592528
  CDS Start-End: 63-1331
ttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtatt

SEQ ID NO: 164394 - DNA, 629 bp, Homo sapiens
  Payload ID: 12384
  Gene Symbol: PLIN3
  Gene Name: perilipin 3
  ENST ID: ENST00000589494
  CDS Start-End: 125-629
tccaagctggttttgaagtcgcggcagctgttcctgggacgtccggttgaccgcggcctggcagtgggacctggggcccttggaattttggaagtccagtcttagcatgctctgaagttgctggatggctgggtctggcctggagctccccttctggagccagcggcaagcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgt

SEQ ID NO: 164395 - DNA, 1699 bp, Homo sapiens
  Payload ID: 12384
  Gene Symbol: PLIN3
  Gene Name: perilipin 3
  ENST ID: ENST00000589163
  CDS Start-End: 1-878
acaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagta

SEQ ID NO: 164396 - DNA, 6353 bp, Homo sapiens
  Payload ID: 12385
  Gene Symbol: PLIN4
  Gene Name: perilipin 4
  Uniprot ID: Q96Q06
  ENST ID: ENST00000301286
  CDS Start-End: 1-4074
atgcagaccctgggcagcttctttgggtccctgcctggcttcagctctgcccggaacctggtggccaacgcacatagctcggcgagagcccggccggccgctgaccccacaggagcgcctgctgccgaggctgcccaaccacaggctcaggtggctgcccacccagagcagacggccccatggacggagaaggagctgcaaccttcggaaaagcagatggtgtccggggccaaagacctggtgtgttccaagatgtccagggccaaggatgccgtgtcctccggggtggccagcgtggtggacgtggctaagggagtggtccagggaggcctggacaccactcggtctgcacttacgggcaccaaggaggtggtgtccagcggggtcacaggggccatggacatggctaagggggccgtccaagggggtctggacacctcgaaggctgtcctcaccggcaccaaggacacggtgtccactgggctcacgggggcagtgaatgtggccaaagggaccgtacaggccggtgtggacaccaccaagactgtgctgaccggcaccaaagacacagtgactactggggtcatgggggcagtgaacttggccaaagggactgtccagactggcgtggaaacctccaaggctgtgctgaccggcaccaaagatgctgtgtccactgggctcacaggggcagtgaatgtggccagaggaagcattcagaccggtgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccaccaagactgtcctaactggcaccaagaacactgtctgcagtggggtgaccggtgccgtgaacttggccaaagaggccatccaggggggcctggataccaccaagtctatggtcatgggtacgaaagacacgatgtccactgggctcacaggggcagcgaatgtggccaagggggccatgcaaactgggctgaacacaacccaaaatatcgcaacaggtacaaaggacaccgtctgcagtggggtgactggtgccatgaatttggccagaggaaccatccagacaggcgtggacaccaccaagatcgttctaactggtaccaaggacactgtctgcagtggggtcaccggtgctgcgaatgtggccaaaggggccgtccagggcggcctggacactacaaagtctgtcctgactggcactaaagatgctgtgtccactgggctcacaggggctgtgaacgtggccaaagggaccgtccagaccggcgtagacaccaccaagactgtcctaaccggcaccaaggacaccgtctgcagtggggtgaccagtgctgtgaacgtggccaaaggggccgtccaggggggcctggacaccaccaagtctgtggtcataggtacaaaagacacgatgtccactgggctcacgggggcagcgaatgtggccaagggggctgtccagacaggtgtagacacagccaagaccgtgctgaccggcaccaaggacacagtgactactgggctcgtgggggcagtgaatgtcgccaaagggaccgtccagacaggcatggacaccaccaaaactgtcctaaccggtaccaaggacaccatctacagtggggtcaccagtgccgtgaacgtggccaagggggctgtgcaaactgggctgaaaacgacccaaaatatcgcgacaggtacaaagaacacctttggcagtggggtgaccagtgctgtgaatgtggccaaaggggctgcccagacaggtgtagacacggccaagaccgtgctgaccggcaccaaggacacagtcactactgggctcatgggggcagtgaatgtcgccaaagggactgtccagaccagtgtggacaccaccaagactgtcctaactggtaccaaggacaccgtctgcagtggggtgaccggtgctgcgaatgtggccaaaggggccatccaagggggcctggacactacaaagtctgtcctgactggcactaaagatgctgtgtccactgggctcacaggggctgtgaagttggccaaagggactgtccagaccggcatggacaccaccaagactgtgttaactggtaccaaggatgctgtgtgcagtggggtgaccggtgctgcgaatgtggccaagggggccgtccagatgggtgtagacacggccaagaccgtgctgaccggtaccaaggacactgtctgcagtggggtcaccggtgctgcgaacgtggccaagggtgctgtgcaaactgggctgaaaacgacccaaaatatcgcaacaggtacaaagaacacccttggcagtggggtgaccggtgctgcgaaagtggccaaaggggccgtccaggggggcctggacactacaaagtctgtcctgactggcactaaagatgccgtgtccactgggctcacaggggctgtgaacttggccaaagggactgtccagaccggcgtggacaccagcaagactgtcctgaccggtaccaaggacaccgtctgcagtggagtcactggtgccgtaaatgtggccaaagggaccgtccagacaggtgtggacacagccaagacggtgctgagtggcgctaaggatgcagtgactactggagtcacgggggcagtgaatgtggccaaaggaaccgtgcagaccggcgtggacgcctccaaggctgtgcttatgggtaccaaggacactgtcttcagtggggttaccggtgccatgagcatggccaaaggggccgtccaggggggcctggacaccaccaagacagtgctgaccggaaccaaagacgcagtgtccgctgggctcatggggtcagggaacgtggcgacaggggccacccacactggcctcagcaccttccagaactggttacctagtacccccgccacctcctggggtggactcaccagttccaggaccacagacaatggtggggagcagactgccctgagcccccaagaggccccgttctctggcatctccacgcccccggatgtgctcagtgtaggcccggagcctgcctgggaagccgcagccactaccaagggccttgcgactgacgtggcgacgttcacccaaggggccgccccaggcagggaggacacggggcttttggccaccacacacggccccgaagaagccccacgcttggcaatgctgcagaatgagttggaggggctgggggacatcttccaccccatgaatgcggaggagcaagctcagctggctgcctcccagcctgggccaaaggtgctgtcggcggaacaggggagctacttcgttcgtttaggtgacctgggtcccagcttccgccagcgggcatttgaacacgcggtgagccacctgcagcacggccagttccaagccagggacactctggcccagctccaggactgcttcaggctgattgaaaaggcccagcaggctccagaagggcagccacgtctggaccagggctcaggtgccagtgcggaggacgctgctgtccaggaggagcgggatgccggggttctgtccagggtctgcggccttctccggcagctgcacacggcctacagtggcctggtctccagcctccagggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggcctacagcacaatcccccgctcagctggctggtagggcccttcgccttgcccgctggcgggcagtagctgtaggagcctgcaggcccggcgcggggtcgccctgctctgtccagggaggagctgcctcagaactttctccccgcccccaaacctggatcggttccctaaagccctagacctttggggctgcagctggctgagcgccgaggggctgcggaggcagtgaccttcttaactgagccaccccacgccctgctccgggcctgcctgcatctcccacctcctccccagcgctgcctgcccctctcggagcctggggtcactcagaccaccagccaagagccttcccttgaagtccccaagcaagcactgcaattaggaaagagaaaaagcagcgtgcccagcctggaagggcatctgtttgccccgctagcaacccttttatatctagcagggctcttccagtcctgcagcacgggcccccagctatcagcggtgcaggcagtgctgtggcatcccaggctccgggcagctccgttctcatgctgaaagtgggtctccggccttagcacacacaccttgagggtcttaagaaccacattccctcatagtagaaagtactagaaaaagcgacactgccatcatcatcccaaggcaggctgctactgcctttgctgacccccggggtggcctcacggtggggacaaagctgccaggagccacagcagccacagctggggctttgcaccagcctggcttgagactgagcagtttgcagggggtggggggtgcaaaaaacaagcaaacaggctgctgctgcctccagctgcccaccacaggcctgccccaggcacctggggctctgaggcccctggggaggctgggcccagcagctgcccctggagaacacagacaaaggacttccccgcagggaactgtgccctatggagggatcagacagggctgggaacagccacagaggctgcgtgcctatggcacagcccttcctccgccgcacactccccctgggtcctcaggcccacccaagcgccgggctgcagaggaagcggggctggggaggctgcaggcatcagagacactggtggtggcggacccggccgccgggccccgtgctctcaggctagcccaggtcgtggaggctggcaggctcaggtcgggtgtgagacgtgccgtggctgcgctcagtccagcggggaggagccgttcagcccggcctccccaggaagccatatccccactcacccggtaagagaaccttgtcgtcccctttccatgctctcctaggacacgagcccaggaaccccagacccagggggaggaagggtggaggggccccaggggtcaccgtgtgcaccaggggccgtgaggggccggggcattcagctcagctctgaaccggggaagctggcacggcaaggactgcctcaggtgacgggccgtgagaggggacgggtcaggagccttcccaagccttctcctcagcccgacacccatggccatcggaggctaggatgccagacacagccatttgcagaaatcaggcacagtgactgcagctcacgtccagccaaccaagcatggggccgcagctcaggaagtcccttcccgccacaccacagcctaattcttactgggacggaggcaactcggctacgctgggcaggacgacaaacacgagacgccactgtggaatgagcaacttcggagcacggggtgacttgcttgggaccgtgcccacgtgacagccccttatgcagaggaggaaagagaagccccgagtgggaggggaacctgtccaaagtcacacggtgtgtgggtgacacagctggggtgagtcgaggctggcccctgaggcccatgctccctgaacgctggagaccactgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgcctgcgccccagctcaggcccccactgcaccagcaatgctagaaaaccaagccaataaaagtgatttcttttttcattaaaaaaccatttatagtc

SEQ ID NO: 164397 - DNA, 6484 bp, Homo sapiens
  Payload ID: 12385
  Gene Symbol: PLIN4
  Gene Name: perilipin 4
  ENST ID: ENST00000633942
  CDS Start-End: 99-4217
gtcctccaggggaccccgcgcagtccaggtgagcggggccgcgtctgcttcggtgacaccagggtgaggccaggcctgcagcttctcacgttctcactatgtctgctccagacgaagggagacgggatccccccaaaccgaagggcaagaccctgggcagcttctttgggtccctgcctggcttcagctctgcccggaacctggtggccaacgcacatagctcggcgagagcccggccggccgctgaccccacaggagcgcctgctgccgaggctgcccaaccacaggctcaggtggctgcccacccagagcagacggccccatggacggagaaggagctgcaaccttcggaaaagcagatggtgtccggggccaaagacctggtgtgttccaagatgtccagggccaaggatgccgtgtcctccggggtggccagcgtggtggacgtggctaagggagtggtccagggaggcctggacaccactcggtctgcacttacgggcaccaaggaggtggtgtccagcggggtcacaggggccatggacatggctaagggggccgtccaagggggtctggacacctcgaaggctgtcctcaccggcaccaaggacacggtgtccactgggctcacgggggcagtgaatgtggccaaagggaccgtacaggccggtgtggacaccaccaagactgtgctgaccggcaccaaagacacagtgactactggggtcatgggggcagtgaacttggccaaagggactgtccagactggcgtggaaacctccaaggctgtgctgaccggcaccaaagatgctgtgtccactgggctcacaggggcagtgaatgtggccagaggaagcattcagaccggtgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccaccaagactgtcctaactggcaccaagaacactgtctgcagtggggtgaccggtgccgtgaacttggccaaagaggccatccaggggggcctggataccaccaagtctatggtcatgggtacgaaagacacgatgtccactgggctcacaggggcagcgaatgtggccaagggggccatgcaaactgggctgaacacaacccaaaatatcgcaacaggtacaaaggacaccgtctgcagtggggtgactggtgccatgaatttggccagaggaaccatccagacaggcgtggacaccaccaagatcgttctaactggtaccaaggacactgtctgcagtggggtcaccggtgctgcgaatgtggccaaaggggccgtccagggcggcctggacactacaaagtctgtcctgactggcactaaagatgctgtgtccactgggctcacaggggctgtgaacgtggccaaagggaccgtccagaccggcgtagacaccaccaagactgtcctaaccggcaccaaggacaccgtctgcagtggggtgaccagtgctgtgaacgtggccaaaggggccgtccaggggggcctggacaccaccaagtctgtggtcataggtacaaaagacacgatgtccactgggctcacgggggcagcgaatgtggccaagggggctgtccagacaggtgtagacacagccaagaccgtgctgaccggcaccaaggacacagtgactactgggctcgtgggggcagtgaatgtcgccaaagggaccgtccagacaggcatggacaccaccaaaactgtcctaaccggtaccaaggacaccatctacagtggggtcaccagtgccgtgaacgtggccaagggggctgtgcaaactgggctgaaaacgacccaaaatatcgcgacaggtacaaagaacacctttggcagtggggtgaccagtgctgtgaatgtggccaaaggggctgcccagacaggtgtagacacggccaagaccgtgctgaccggcaccaaggacacagtcactactgggctcatgggggcagtgaatgtcgccaaagggactgtccagaccagtgtggacaccaccaagactgtcctaactggtaccaaggacaccgtctgcagtggggtgaccggtgctgcgaatgtggccaaaggggccatccaagggggcctggacactacaaagtctgtcctgactggcactaaagatgctgtgtccactgggctcacaggggctgtgaagttggccaaagggactgtccagaccggcatggacaccaccaagactgtgttaactggtaccaaggatgctgtgtgcagtggggtgaccggtgctgcgaatgtggccaagggggccgtccagatgggtgtagacacggccaagaccgtgctgaccggtaccaaggacactgtctgcagtggggtcaccggtgctgcgaacgtggccaagggtgctgtgcaaactgggctgaaaacgacccaaaatatcgcaacaggtacaaagaacacccttggcagtggggtgaccggtgctgcgaaagtggccaaaggggccgtccaggggggcctggacactacaaagtctgtcctgactggcactaaagatgccgtgtccactgggctcacaggggctgtgaacttggccaaagggactgtccagaccggcgtggacaccagcaagactgtcctgaccggtaccaaggacaccgtctgcagtggagtcactggtgccgtaaatgtggccaaagggaccgtccagacaggtgtggacacagccaagacggtgctgagtggcgctaaggatgcagtgactactggagtcacgggggcagtgaatgtggccaaaggaaccgtgcagaccggcgtggacgcctccaaggctgtgcttatgggtaccaaggacactgtcttcagtggggttaccggtgccatgagcatggccaaaggggccgtccaggggggcctggacaccaccaagacagtgctgaccggaaccaaagacgcagtgtccgctgggctcatggggtcagggaacgtggcgacaggggccacccacactggcctcagcaccttccagaactggttacctagtacccccgccacctcctggggtggactcaccagttccaggaccacagacaatggtggggagcagactgccctgagcccccaagaggccccgttctctggcatctccacgcccccggatgtgctcagtgtaggcccggagcctgcctgggaagccgcagccactaccaagggccttgcgactgacgtggcgacgttcacccaaggggccgccccaggcagggaggacacggggcttttggccaccacacacggccccgaagaagccccacgcttggcaatgctgcagaatgagttggaggggctgggggacatcttccaccccatgaatgcggaggagcaagctcagctggctgcctcccagcctgggccaaaggtgctgtcggcggaacaggggagctacttcgttcgtttaggtgacctgggtcccagcttccgccagcgggcatttgaacacgcggtgagccacctgcagcacggccagttccaagccagggacactctggcccagctccaggactgcttcaggctgattgaaaaggcccagcaggctccagaagggcagccacgtctggaccagggctcaggtgccagtgcggaggacgctgctgtccaggaggagcgggatgccggggttctgtccagggtctgcggccttctccggcagctgcacacggcctacagtggcctggtctccagcctccagggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggcctacagcacaatcccccgctcagctggctggtagggcccttcgccttgcccgctggcgggcagtagctgtaggagcctgcaggcccggcgcggggtcgccctgctctgtccagggaggagctgcctcagaactttctccccgcccccaaacctggatcggttccctaaagccctagacctttggggctgcagctggctgagcgccgaggggctgcggaggcagtgaccttcttaactgagccaccccacgccctgctccgggcctgcctgcatctcccacctcctccccagcgctgcctgcccctctcggagcctggggtcactcagaccaccagccaagagccttcccttgaagtccccaagcaagcactgcaattaggaaagagaaaaagcagcgtgcccagcctggaagggcatctgtttgccccgctagcaacccttttatatctagcagggctcttccagtcctgcagcacgggcccccagctatcagcggtgcaggcagtgctgtggcatcccaggctccgggcagctccgttctcatgctgaaagtgggtctccggccttagcacacacaccttgagggtcttaagaaccacattccctcatagtagaaagtactagaaaaagcgacactgccatcatcatcccaaggcaggctgctactgcctttgctgacccccggggtggcctcacggtggggacaaagctgccaggagccacagcagccacagctggggctttgcaccagcctggcttgagactgagcagtttgcagggggtggggggtgcaaaaaacaagcaaacaggctgctgctgcctccagctgcccaccacaggcctgccccaggcacctggggctctgaggcccctggggaggctgggcccagcagctgcccctggagaacacagacaaaggacttccccgcagggaactgtgccctatggagggatcagacagggctgggaacagccacagaggctgcgtgcctatggcacagcccttcctccgccgcacactccccctgggtcctcaggcccacccaagcgccgggctgcagaggaagcggggctggggaggctgcaggcatcagagacactggtggtggcggacccggccgccgggccccgtgctctcaggctagcccaggtcgtggaggctggcaggctcaggtcgggtgtgagacgtgccgtggctgcgctcagtccagcggggaggagccgttcagcccggcctccccaggaagccatatccccactcacccggtaagagaaccttgtcgtcccctttccatgctctcctaggacacgagcccaggaaccccagacccagggggaggaagggtggaggggccccaggggtcaccgtgtgcaccaggggccgtgaggggccggggcattcagctcagctctgaaccggggaagctggcacggcaaggactgcctcaggtgacgggccgtgagaggggacgggtcaggagccttcccaagccttctcctcagcccgacacccatggccatcggaggctaggatgccagacacagccatttgcagaaatcaggcacagtgactgcagctcacgtccagccaaccaagcatggggccgcagctcaggaagtcccttcccgccacaccacagcctaattcttactgggacggaggcaactcggctacgctgggcaggacgacaaacacgagacgccactgtggaatgagcaacttcggagcacggggtgacttgcttgggaccgtgcccacgtgacagccccttatgcagaggaggaaagagaagccccgagtgggaggggaacctgtccaaagtcacacggtgtgtgggtgacacagctggggtgagtcgaggctggcccctgaggcccatgctccctgaacgctggagaccactgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgcctgcgccccagctcaggcccccactgcaccagcaatgctagaaaaccaagccaataaaagtgatttcttttttcattaaaaaa

SEQ ID NO: 164398 - DNA, 2470 bp, Homo sapiens
  Payload ID: 12386
  Gene Symbol: PLIN5
  Gene Name: perilipin 5
  Uniprot ID: Q00G26
  ENST ID: ENST00000381848
  CDS Start-End: 82-1473
gtggagactcgagcctggggtcggcggagacagctggtgtctgaagccgctcgcgcccagggtgaccctgtttgcagcacgatgtctgaagaagaggcggctcagatccccagatccagtgtgtgggagcaggaccagcagaacgtggtgcagcgtgtggtggctctgcccctggtcagggccacgtgcaccgcggtctgcgatgtttacagtgcagccaaggacaggcacccgctgctgggctccgcctgccgcctggctgagaactgcgtgtgcggcctgaccacccgtgccctggaccacgcccagccgctgctcgagcacctgcagccccagctggccactatgaacagcctcgcctgcaggggcctggacaagctggaagagaagcttccctttctccagcaaccttcggagacggtggtgacctcagccaaggacgtggtggccagcagtgtcacgggtgtggtggacctggcccggaggggccggcgctggagcgtggagctgaagcgctccgtgagccatgctgtggatgttgtactggaaaaatcagaggagctggtggatcacttcctgcccatgacggaggaagagctcgcggcactggcggctgaggctgaaggccctgaagtgggttcggtggaggatcagaggagacagcagggctactttgtgcgcctcggctccctgtcagcacggatccgccacctggcctacgagcactctgtggggaaactgaggcagagcaaacaccgtgcccaggacaccctggcccagctgcaggagacgctggagctgatagaccacatgcagtgtggggtgacccccaccgccccggcctgccctgggaaggtgcacgagctgtggggggaatggggccagcgccctccggagagccgccgccggagccaggcagagctggagacgctggtgctgtcccgcagcctgacccaggagctgcagggcacggtagaggctctggagtccagcgtgcggggcctgcccgccggcgcccaggagaaggtggctgaggtgcggcgcagtgtggatgccctgcagaccgccttcgctgatgcccgctgcttcagggacgtgccagcggccgcgctggccgagggccggggtcgcgtggcccacgcgcacgcctgcgtggacgagctgctggagctggtggtgcaggccgtgccgctgccctggctggtgggacccttcgcgcccatccttgtggagcgacccgagcccctgcccgacctggcggacctggtggacgaggtcatcgggggccctgacccccgctgggcgcacctggactggccggcccagcagagagcctgggaggcagagcacagggacgggagtgggaatggggatggggacaggatgggtgttgccggggacatctgcgagcaggaacccgagacccccagctgcccggtcaagcacaccctgatgcccgagctggacttctgacccatgggccagtggaggcggggaggaaaggccacctgcacaccccgatccctgctgccccctggtggccacacgtaagctcgaggccttggccttgacccttctttggaatcaggcccaactccggatctctgaccacctttttggtattggactctcccattttttccttgaacacatggacaaagaggcccgggggagcagggcctcgaaccctattcaggccaacttgagccacaagctgggttcttcacctatgtcctgctccctggctccatgaagcgaatccaaatctttccaagaggctgggcacagtggctcacgcctgtaatcccagcactttgggagtctgaggcaggtggatcatctgaagtcaggagttcgggatcatcctggccaacatgatgaaaccctgtctctacttagaaagaaagaaaaaaaaaaaaaaagccaggtgtggtggtgtgcacctgtagtcccagctagttgtgaggctgacgcagaagaattgcttaaacccgagaggcgcggagcttgcagtgagcagagatcgcgccactgcacaccagcctgggtgacagagcgagactccatctaacaaaaaataatagtaacagcctcccgaagaaatacacattttgcccaatgccttctgtttggggctttgaaaagtgagccctgactgggtgtggtggttgacacctgttatcacagcactttgggaggccaaggtgggaggactgcttgagcccaggagttggaggctgcagtgagccatgatcttgcccctgcgctctcgcctgggtgacagagcaagactctatctcaaaaatgtttttaaaaaatacttcctagggaaacacacattttgccctatttggaactttgaaaagtgagccctcctctgcccatgggccgtgctgctcagcctgccatactcgcttgctttgctgtttgggatttgcctccagaataaaggtcctttttgttgttgaaa

SEQ ID NO: 164399 - DNA, 1903 bp, Homo sapiens
  Payload ID: 12386
  Gene Symbol: PLIN5
  Gene Name: perilipin 5
  ENST ID: ENST00000592610
  CDS Start-End: 201-377
ggacaccctctgtgtacagagctctggacatgcattgtctgagctccacagaatgccccattatgcagatgaagaaactgaggccccaagaggtttgagagttgctcaagtcacagagcccaatttgacaggatctgatgcctgggcaggtgctccccttactcaatcctgccccgcagggtgaccctgtttgcagcacgatgtctgaagaagaggcggctcagatccccagatccagtgtgtgggagcaggaccagcaggtgagggctgcccctcccatggagcagggacagaaggtattgtgtgggacagtcccttctaggagcgtttcaggccaggtatcccgccccactcctctccttgctgggaaaacctgagtcataaaatattttggtccatggaggggatggtctatttcctagtgggggcttaatgaggccctgggaggggagtgtctctcaaagacacccagctggcttctgtggcccctacccaaccctttccctctcctttgatccctgggtctccacctgtatccttctgtctccacgtccaccatcatggcgccctcagtaacaacaatagtaagagcagcaatcactgtatcagtcacagttccaaccgtttcatgtatattggctccttgaacacccatcacaaccctagtaacccatttcatagatggggaaacaaaggcaccgaacagttcagtggcttgcccaagttcacacaacttgcaggcagctgaaccagaagtgaacagaggccactgtgctccaggggcagtgctctgaacccccagactctaacatctcctccctcgagcagacagatcgcagtggacccttcaacaacatgggtttgaactgcacaggtcaggctgggtgcggtggctcagacgcctgtaatcccagcactttgggaggccaagcgggcagatcaactgaggtcaggagttcgagaccagcctggctaacttggtgaaaccctgtctctactaaaaatacaagaattagccgggtgtggtggcgggtgcctgtattcccagctactcgggagcctgaggcaggagaaccgcttgaaccctgaaggcgggggttgcagtgagccgagatcacgccactgcactccagcctaggtaacaagaacgagactccatctcaaaaaaaaaaaaaagccaggtggggtggtgcctgcctggaatcccagctaattgggaggctgaggcaggagaatctcttgaacccaggagacagaagtatgcagacctttttcaaccaaatgcagataaaaaaaatatagtatttggccaggtgcagtggctcatgcctataatcccagcatattaggagactgaagcgggaggatcgcttgagccaggagttcaagaccagcatgggcaacacagcaagacccaatctctataaaataaaataaaattagctgggcacagtggtgtgcacctgtaatcccaggtacttggaaactgaggttggaggattgcttgaggctaggaggcttaggctgcagtgagccgtgcttgaatcactgccctctagcctggccaacagagcaagaccttgtctctattgaaaacaaaaaaattgtgaccaggtgcaatggctcaggcctgtaatcctagcactttgggaggctgaggtgggtggatcacctgaggtgggtggatcacctgaggtcgggagttcgacaccagcctggtcaacatagtgaaaccctgtttctactaaaaataaaaataaaaacaaaattggctgggcgcggtggctcacgcctgtaatccctgcactttgggaggccaaggcaggtggatcacctgaggtcggtagtttgagaccagcctgaccaatgtggagaaaccccatctctactaaaaatacacaaa

SEQ ID NO: 164400 - DNA, 907 bp, Homo sapiens
  Payload ID: 12386
  Gene Symbol: PLIN5
  Gene Name: perilipin 5
  ENST ID: ENST00000586133
  CDS Start-End: 82-258
gtggagactcgagcctggggtcggcggagacagctggtgtctgaagccgctcgcgcccagggtgaccctgtttgcagcacgatgtctgaagaagaggcggctcagatccccagatccagtgtgtgggagcaggaccagcaggtgagggctgcccctcccatggagcagggacagaaggtattgtgtgggacagtcccttctaggagcgtttcaggccaggtatcccgccccactcctctccttgctgggaaaacctgagtcataaaatattttggtccatggaggggatggtctatttcctagtgggggcttaatgaggccctgggaggggagtgtctctcaaagacacccagctggcttctgtggcccctacccaaccctttccctctcctttgatccctgggtctccacctgtatccttctgtctccacgtccaccatcatggcgccctcagtaacaacaatagtaagagcagcaatcactgtatcagtcacagttccaaccgtttcatgtatattggctccttgaacacccatcacaaccctagtaacccatttcatagatggggaaacaaaggcaccgaacagttcagtggcttgcccaagttcacacaacttgcaggcagctgaaccagaagtgaacagaggccactgtgctccaggggcagtgctctgaacccccagactctaacatctcctccctcgagcagacagatcgcagtggacccttcaacaacatgggtttgaactgcacaggtcaggctgggtgcggtggctcagacgcctgtaatcccagcactttgggaggccaagcgggcagatcaactgaggtcaggagttcgagaccagcctggctaacttggtgaaaccctgtctctactaaaaatacaagaattagccgggtgtgg

SEQ ID NO: 164401 - DNA, 4707 bp, Homo sapiens
  Payload ID: 12387
  Gene Symbol: PER1
  Gene Name: period circadian clock 1
  Uniprot ID: O15534
  ENST ID: ENST00000317276
  CDS Start-End: 239-4111
attatgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgcc

SEQ ID NO: 164402 - DNA, 3115 bp, Homo sapiens
  Payload ID: 12387
  Gene Symbol: PER1
  Gene Name: period circadian clock 1
  Uniprot ID: O15534
  ENST ID: ENST00000354903
  CDS Start-End: 7-2586
agtgtaatgctagaagtcctagaagaaatttggagtgtgcgtgcgcgccgagcgcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggc

SEQ ID NO: 164403 - DNA, 4521 bp, Homo sapiens
  Payload ID: 12387
  Gene Symbol: PER1
  Gene Name: period circadian clock 1
  ENST ID: ENST00000581082
  CDS Start-End: 127-3930
tcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaa

SEQ ID NO: 164404 - DNA, 589 bp, Homo sapiens
  Payload ID: 12387
  Gene Symbol: PER1
  Gene Name: period circadian clock 1
  ENST ID: ENST00000577253
  CDS Start-End: 239-589
gtggggggcgtggcagcccggcccgtgggcgggtttggaggagccagtgtaatgctagaagtcctagaagaaatttggagtgtgcgtgcgcgccgagcggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcagtgaacagtcagcccgggcaaggactcagaaggaactcatgacagcacttcgagagctcaagcttcgactgccg

SEQ ID NO: 164405 - DNA, 3677 bp, Homo sapiens
  Payload ID: 12387
  Gene Symbol: PER1
  Gene Name: period circadian clock 1
  ENST ID: ENST00000582719
  CDS Start-End: 148-2622
gcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttg

SEQ ID NO: 164406 - DNA, 523 bp, Homo sapiens
  Payload ID: 12387
  Gene Symbol: PER1
  Gene Name: period circadian clock 1
  ENST ID: ENST00000583559
  CDS Start-End: 1-507
gtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctgg

SEQ ID NO: 164407 - DNA, 528 bp, Homo sapiens
  Payload ID: 12387
  Gene Symbol: PER1
  Gene Name: period circadian clock 1
  ENST ID: ENST00000581703
  CDS Start-End: 4-528
attatgcaacccgcctccccgcccgcccggtggagcttccactcggctgcgggctggagcggcggcgggcaggcgtgcggaggacactcctgcgaccagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtg

SEQ ID NO: 164408 - DNA, 576 bp, Homo sapiens
  Payload ID: 12387
  Gene Symbol: PER1
  Gene Name: period circadian clock 1
  ENST ID: ENST00000584202
  CDS Start-End: 240-576
aatgctagaagtcctagaagaaatttggagtgtgcgtgcgcgccgagcgagacggggtttctccatgttggtcaggctggtctcgaactcgctacctcaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgcca

SEQ ID NO: 164409 - DNA, 3209 bp, Homo sapiens
  Payload ID: 12387
  Gene Symbol: PER1
  Gene Name: period circadian clock 1
  ENST ID: ENST00000581395
  CDS Start-End: 340-2058
atgagaagacgatggcggccggaggtgccaatggaggctgtgcgggggccggcggctgcacgcggcacggggcatgggtcggcgcccctaagccaataagcgtggggggcgtggcagcccggcccgtgggcgggtttggaggagccagtgtaatgctagaagtcctagaagaaatttggagtgtgcgtgcgcgccgagcggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccactacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctgg

SEQ ID NO: 164410 - DNA, 6385 bp, Homo sapiens
  Payload ID: 12388
  Gene Symbol: PER2
  Gene Name: period circadian clock 2
  Uniprot ID: O15055
  ENST ID: ENST00000254657
  CDS Start-End: 281-4048
gtaaccgccgccggcgcgcgggcctcgggcaggtcggggtcccagcgccggctcgggcagcggaggcgccgccggaagttccttgggctgctggactcctcggcttgaaacggcgccggcgtgggggcgtgtgcccttggccctgtcccaggtggagagtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagggcggtccctctcctgggctacctacctcaggacctgattgaaaccccagtgctcgtgcagctccaccctagtgacaggcccttgatgctggccatccacaaaaagatcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcattgtatattccaaagatggttcagaaaatttaatattggtccctggtggaaattcaaagttatcactgaagaacagttgacttaaaattggaccaagactatgaggcttaaaagggaccagggttttcttttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttattttta

SEQ ID NO: 164411 - DNA, 1228 bp, Homo sapiens
  Payload ID: 12388
  Gene Symbol: PER2
  Gene Name: period circadian clock 2
  Uniprot ID: O15055
  ENST ID: ENST00000355768
  CDS Start-End: 1-1215
atgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgca

SEQ ID NO: 164412 - DNA, 551 bp, Homo sapiens
  Payload ID: 12388
  Gene Symbol: PER2
  Gene Name: period circadian clock 2
  ENST ID: ENST00000431832
  CDS Start-End: 224-551
atcacactcaggaattcctgatgtgggttcataacttttccttctgtcccatccctggtccccaggtgagtccaggtaaagaagaacaagaagagtaaagagagatgctgcgggctccagcttcttggacagtctcgccttccccatgagagcctacacattcagagcctgctgcgtgggagcctgaaagctccttcctgtcctcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaag

SEQ ID NO: 164413 - DNA, 6203 bp, Homo sapiens
  Payload ID: 12389
  Gene Symbol: PER3
  Gene Name: period circadian clock 3
  Uniprot ID: P56645
  ENST ID: ENST00000361923
  CDS Start-End: 176-3781
ggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtga

SEQ ID NO: 164414 - DNA, 6279 bp, Homo sapiens
  Payload ID: 12389
  Gene Symbol: PER3
  Gene Name: period circadian clock 3
  Uniprot ID: P56645
  ENST ID: ENST00000377532
  CDS Start-End: 225-3857
gccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgagtcagcgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtatcagtgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtga

SEQ ID NO: 164415 - DNA, 1524 bp, Homo sapiens
  Payload ID: 12389
  Gene Symbol: PER3
  Gene Name: period circadian clock 3
  ENST ID: ENST00000377541
  CDS Start-End: 282-1418
gcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgtaagccagtcagttttcatattttctaaaacatctcttgtatcaaataatattccttagcttattgactgccctctgactcaattgacacataaactaaataaagcaca

SEQ ID NO: 164416 - DNA, 6261 bp, Homo sapiens
  Payload ID: 12389
  Gene Symbol: PER3
  Gene Name: period circadian clock 3
  ENST ID: ENST00000614998
  CDS Start-End: 265-3840
actcgcgcgcggcagaggagccccgcgagccctgccctcggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgagtcagcgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtg

SEQ ID NO: 164417 - DNA, 6318 bp, Homo sapiens
  Payload ID: 12389
  Gene Symbol: PER3
  Gene Name: period circadian clock 3
  Uniprot ID: P56645
  ENST ID: ENST00000613533
  CDS Start-End: 265-3897
actcgcgcgcggcagaggagccccgcgagccctgccctcggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgagtcagcgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtatcagtgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtg

SEQ ID NO: 164418 - DNA, 3071 bp, Homo sapiens
  Payload ID: 12390
  Gene Symbol: POSTN
  Gene Name: periostin, osteoblast specific factor
  Uniprot ID: Q15063
  ENST ID: ENST00000379742
  CDS Start-End: 33-2372
ttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactt

SEQ ID NO: 164419 - DNA, 3196 bp, Homo sapiens
  Payload ID: 12390
  Gene Symbol: POSTN
  Gene Name: periostin, osteoblast specific factor
  Uniprot ID: Q15063
  ENST ID: ENST00000379743
  CDS Start-End: 25-2454
ctaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattga

SEQ ID NO: 164420 - DNA, 3373 bp, Homo sapiens
  Payload ID: 12390
  Gene Symbol: POSTN
  Gene Name: periostin, osteoblast specific factor
  Uniprot ID: Q15063
  ENST ID: ENST00000379747
  CDS Start-End: 119-2629
agactctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaat

SEQ ID NO: 164421 - DNA, 3210 bp, Homo sapiens
  Payload ID: 12390
  Gene Symbol: POSTN
  Gene Name: periostin, osteoblast specific factor
  ENST ID: ENST00000379749
  CDS Start-End: 36-2462
ctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 164422 - DNA, 3113 bp, Homo sapiens
  Payload ID: 12390
  Gene Symbol: POSTN
  Gene Name: periostin, osteoblast specific factor
  Uniprot ID: Q15063
  ENST ID: ENST00000541481
  CDS Start-End: 119-2368
agactctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatg

SEQ ID NO: 164423 - DNA, 3214 bp, Homo sapiens
  Payload ID: 12390
  Gene Symbol: POSTN
  Gene Name: periostin, osteoblast specific factor
  Uniprot ID: Q15063
  ENST ID: ENST00000541179
  CDS Start-End: 119-2464
agactctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaatt

SEQ ID NO: 164424 - DNA, 3608 bp, Homo sapiens
  Payload ID: 12391
  Gene Symbol: PMP2
  Gene Name: peripheral myelin protein 2
  Uniprot ID: P02689
  ENST ID: ENST00000256103
  CDS Start-End: 138-536
acactgcctttccccattgggtctctgtaagagtcacacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtacaagactttttgtaaacataggagtccctttattttaaataaataactagtcatatcattaggtccagtaattgttgacaggcaggaacgggggaccattgcattgtgcccaagtaataataaaactatttcagatgtattatatgattgagcaaatgagaaaacatgttgatgttgatgggagtcaggatgttcactatggaaaaacaaatatacaaatatgaaatgagggaaggcaagaaagaaccatgtggaaatggaatagaattggtataaattcataatttctaaaccatgtatatgtacgtttatatgtattataattgcatacacatgcctccatgcatatatgtgtgtgataatacacatgcatttatgtgcgtgtgtgtatacacatgcatatatttactaatcctatctgccaaaatggcttagacacaaaaacacctcagcagaaatgaatatacctagcactcagatcttcgtgtctaatatagtttgccactaaaaggaaccaaggctacttggaaaaatggatgattccaaagcaagggcaaggtaggaacaagatgagcttgaaatatcttgttatgccagaaagtaatgttaaaaaaaaaaatagaggtatattgccaaaacatagagccagcttgaaggggctcccactggccaaacttgagccaatctgagagcaaaataattgagaaaaataaataacaagataattgagaaaaaaataaaataaattcccaattccattgggaaaaaatagaaatccatgaatccatactgatataatgatagataatcgatagataggtagatgactgacagatgatagatagatatatagatagatagatagatagatagatagatagatagatagatagagaaatgagaaggtttctcttttgcaatagaacgtcatggaccagtgttaaatgtgagtggaaggagttctggaattggaaaaccatcatttttcaaccatcacagtaaatatggctcaggcaagaattatcaatcaatgctaaagctagggggaaatttcgcttaggagcaggatattagggtattagtctgggcttaaagtatctcctcacagattgttgttagtttctggggaaagaatagtaaccatgcaatggaaaaaaatggacaacctcttgactaggttatcaaaattaacctcaccaataaagggtggatgttcaacatgtgccttcaaatgtgacccactgagaaggaaacaacatcactgtaacaacaacaaccagaaacgacagggggttttgactgaattcttcaaaaatgtcaatgtcatagaagacaaagaaaggttgtggaaatgtttcagattaaatgatagtaaaaacacctgacaactaaacatagtaagtaatactagactggattctgtaccagaggtaacataagtgctccaaaggacaatgttaggtcaactggcaaattggaatatagacagtcaatcagataagaagtatactttgattaagtaaaaaaaatccctattcttggaaaatacacaataaagtattttgaggtaaagggccataatgtatgcaatctactctcaaaaaattcagaaacatatatttgtgtgcatttgcatgtgcaacagtacacacaaacatacataaagagagcaattgataaggcaaataaggtaacatttaacaataatctgatacacataaatagagaaagagcaattgataaagtaaatgaggtaaaatttaacaataatctgagcaaaaggtatatgtgttttctttgagacagtctgattcttgcaacttattctgtaagttggaacttatttccaaacatgattgaaaaaaaaccccgcacttggcaacttcttctctttttcagcctagaaatgtctgtgttaagtggttttttatttattgttgttgtttgttgttattgttgttttgttgccaggctccaactcacaaaatacgagtttaaaaactgcgttgttatttttagagatttgtgataatacaacttgttataaaatttattcctcaataaatataatttctctactatgcaaaaa

SEQ ID NO: 164425 - DNA, 1264 bp, Homo sapiens
  Payload ID: 12391
  Gene Symbol: PMP2
  Gene Name: peripheral myelin protein 2
  ENST ID: ENST00000519260
  CDS Start-End: 54-236
atctgagtcttctgaatcccacttagaactgtgttgagctctcacccatcacgatgagcaacaaattcctgggcacctggaaacttgtctctagtgagaactttgacgattacatgaaagctctggagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtaca

SEQ ID NO: 164426 - DNA, 1810 bp, Homo sapiens
  Payload ID: 12392
  Gene Symbol: PMP22
  Gene Name: peripheral myelin protein 22
  Uniprot ID: Q01453
  ENST ID: ENST00000312280
  CDS Start-End: 189-671
agggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcac

SEQ ID NO: 164427 - DNA, 816 bp, Homo sapiens
  Payload ID: 12392
  Gene Symbol: PMP22
  Gene Name: peripheral myelin protein 22
  ENST ID: ENST00000395936
  CDS Start-End: 148-504
tcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctgaatcaaactcaagtcaaatgtgtggttaccgggattaagaacagaaagaatagaggggactcctgagtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaaca

SEQ ID NO: 164428 - DNA, 1817 bp, Homo sapiens
  Payload ID: 12392
  Gene Symbol: PMP22
  Gene Name: peripheral myelin protein 22
  Uniprot ID: Q01453
  ENST ID: ENST00000395938
  CDS Start-End: 196-678
tgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcac

SEQ ID NO: 164429 - DNA, 571 bp, Homo sapiens
  Payload ID: 12392
  Gene Symbol: PMP22
  Gene Name: peripheral myelin protein 22
  ENST ID: ENST00000426385
  CDS Start-End: 123-500
agctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtaagttgtggatggtaaagtccatgtggaagcggggtgcatccaagtctgcggaatgattagtttagtagaaggatgtggcctcagaatgactgatgttcatgagtctccccactggatgctttccata

SEQ ID NO: 164430 - DNA, 872 bp, Homo sapiens
  Payload ID: 12392
  Gene Symbol: PMP22
  Gene Name: peripheral myelin protein 22
  ENST ID: ENST00000494511
  CDS Start-End: 168-653
gggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccggaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaa

SEQ ID NO: 164431 - DNA, 428 bp, Homo sapiens
  Payload ID: 12392
  Gene Symbol: PMP22
  Gene Name: peripheral myelin protein 22
  ENST ID: ENST00000580584
  CDS Start-End: 275-428
agttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccggcaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatg

SEQ ID NO: 164432 - DNA, 1822 bp, Homo sapiens
  Payload ID: 12392
  Gene Symbol: PMP22
  Gene Name: peripheral myelin protein 22
  Uniprot ID: Q01453
  ENST ID: ENST00000612492
  CDS Start-End: 200-682
tgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgtaagcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcact

SEQ ID NO: 164433 - DNA, 3245 bp, Homo sapiens
  Payload ID: 12393
  Gene Symbol: PRPH
  Gene Name: peripherin
  Uniprot ID: P41219
  ENST ID: ENST00000257860
  CDS Start-End: 1500-2912
agatgcactctcttgtcctcaggtcccatctgaggcagacctgtctcacaggacagcgctggagtccccagcagcagcagcagccccagccctatggttcctggcaaacccagcagacctcagcaacccggctcctgcagaccatccgagctgcctctgtccactcctgggcaggttgtgcttgcattctggaagctgtttgacatacaaaggccagatatcagccttctcgctaactctggagtaggggagggtgtggtgggatgtgtgattgtgtgtgtatgtgtgtgtatgtagtgtgtgtgcgcatagatatacaaagctgtgtgtatgcatctgtttgcgtgcgcaggtttgtggacctgttctggggccttctctctttcagactgctggggatgggcactttctctttccccatctcttccccatccagccccacccatccctggtacctgcaactcatcaatactggaaaccagctcctgccagtccatccatctctcagccttggcagccgctgttgcccctcagccccctccccttcctacctcaggaatcactctggttcctgtaaagcccatgactgagcagcaattggtgtggggttggggggagggagaatccagtaaaccaagacagaatacaaaaggcccacttagcccagcccgtggcatggggcagaccctcccgagtgggatccagagctgggtccagccaccctcagccccctatgatgtacccacctcattggggcttgttgcggggtaggtctaggtttgggggctgtgtctttaaggctgaaacatcagcagacaacctctgctgggccgtcttcaggggagggggaggggggctggtcagcccattagcagcagagctggcgccaggcaccagcccttcacagggccctggggattagggagagtagctcttccccagcccgatctgcctctgcgcccctgtctcctattcctctctgggtgtggtgaaggaggggtagctgacagcaggtgaaaatagagcctggccttcagggggcaagtcaaggcactagctatggggcctaagccaggtcaactctccctccagctggcctcctccctactcctgtgccagaagcctgccctttaacttcaggtccttctacctcgcaattttcagggactctagttcaagtcaggccttcctaccctaggttctagctttgggtgcttgttgggaggaagtgacccccaccccagcggcaacagggggcaatcaagtgggtagaggcctgcaaccagggaagggaggggaaggcgctcctgctgttccgcaggggtggggcatccccctccccatacaacccccctccagcgggccatcaggccagtgggaggagctgcccgtgccccccctgagaccgcagggctataaagccgcctcgcagcggtctgcggctccttcccagcccccggcctagctctgcgaacggtgactgcccatccttggccgcaatgagccaccacccgtcgggcctccgggccggcttcagctccacctcataccgccgtaccttcggtccaccgccctcactatcccccggggccttctcctactcgtccagctcccgcttctccagcagccgcctgctgggctccgcgtccccgagctcctcggtgcgcctgggcagcttccgtagcccccgagcgggagcgggcgccctcctgcgcctgccctcggagcgcctcgacttctccatggccgaggccctcaaccaggagttcctggccacgcgcagcaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggttggaggaggagacgcgcaagcgggaggacgcggagcacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcgggcgctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaa

SEQ ID NO: 164434 - DNA, 704 bp, Homo sapiens
  Payload ID: 12393
  Gene Symbol: PRPH
  Gene Name: peripherin
  ENST ID: ENST00000451891
  CDS Start-End: 83-704
ggtgcgcctgggcagcttccgtagcccccgagcgggagcgggcgccctcctgcgcctgccctcggagcgcctcgacttctccatggccgaggccctcaaccaggagttcctggccacgcgcagcaacgagaagcaggagctgcaggagctcaacgaccgcttcgccaacttcatcgagaaggagctgcgcgagctgcggcgagagctggagctgttgggccgcgagcgtgaccgggtgcaggtggagcgcgacgggctggcggaggacctggcggcgctcaagcagaggttggaggaggagacgcgcaagcgggaggacgcggagcacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccaga

SEQ ID NO: 164435 - DNA, 840 bp, Homo sapiens
  Payload ID: 12393
  Gene Symbol: PRPH
  Gene Name: peripherin
  ENST ID: ENST00000532332
  CDS Start-End: 1-601
cgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcgggcgctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggagcaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccc

SEQ ID NO: 164436 - DNA, 2976 bp, Homo sapiens
  Payload ID: 12394
  Gene Symbol: PRPH2
  Gene Name: peripherin 2 (retinal degeneration, slow)
  Uniprot ID: P23942
  ENST ID: ENST00000230381
  CDS Start-End: 241-1281
caacgcccaggaccaggactatcccctgctcaagctgtgattccgagacccctgccaccactactgcattcacggggatcccaggctagtgggactcgacatgggtagcccccagggcagctccctacagcttgggccatctgcacttttcccaaggccctaagtctccgcctctgggctcgttaaggtttggggtgggagctgtgctgtgggaagcaacccggactacacttggcaagcatggcgctactgaaagtcaagtttgaccagaagaagcgggtcaagttggcccaagggctctggctcatgaactggttctccgtgttggctggcatcatcatcttcagcctaggactgttcctgaagattgaactccgaaagaggagcgatgtgatgaataattctgagagccattttgtgcccaactcattgatagggatgggggtgctatcctgtgtcttcaactcgctggctgggaagatctgctacgacgccctggacccagccaagtatgccagatggaagccctggctgaagccgtacctggctatctgtgttctcttcaacatcatcctcttccttgtggctctctgctgctttctgcttcggggctcgctggagaacaccctgggccaagggctcaagaacggcatgaagtactaccgggacacagacacccctggcaggtgtttcatgaagaagaccatcgacatgctgcagatcgagttcaaatgctgcggcaacaacggttttcgggactggtttgagattcagtggatcagcaatcgctacctggacttttcctccaaagaagtcaaagatcgaatcaagagcaacgtggatgggcggtacctggtggacggcgtccctttcagctgctgcaatcctagctcgccacggccctgcatccagtatcagatcaccaacaactcagcacactacagttacgaccaccagacggaggagctcaacctgtgggtgcgtggctgcagggctgccctgctgagctactacagcagcctcatgaactccatgggtgtcgtcacgctcctcatttggctcttcgaggtgaccattacaattgggctgcgctacctacagacgtcgctggatggtgtgtccaaccccgaggaatctgagagcgagagccagggctggctgctggagaggagcgtgccggagacctggaaggcctttctggagagtgtgaagaagctgggcaagggcaaccaggtggaagccgagggcgcagacgcaggccaggccccagaggctggctgagggccctggggcccctcccctcccgaacactgagaaatagtgcactccaagaaacgtggatctccccctcatccaactccgaaagtctgaatctcccaaggagggcaccatcttacagagactctccctgacggtggaatttaagtttagggtccctaaaagcatttgacacacagttgttgaatgactgacccaaaatgtgaatgaagctaatgtgaatgtgagtgaagctcccttcaggcccgctgccctaggatatgccctcctggtgactcgggggctgtctcagacgactagcccaggacccatctttctcacacggatttagtcccaccctatggccactggccgtatctgagggctgctccccttttagaatttacctcttatgagctccatgttgcttcactctatccaaagtgtcacttggtgcataagcacagaaatctgaaaaatggccatgttgtcttttttttttttttttaatgccaagattgacaggttggccgtttgcttaatgccagaagttgggggaaagttacgcttttctaagaataatggactcttaaggcattgagggctctaaacaggattctttaatcatggagcaagagaatttcaaggcaggggattttatcccccaccaaaaacacagtgaaaggcctgcttttgtgtcccattcacatgccctcggtcactgagtctggagtgaaccacgggttgaggaagtcaggctgttggcgtgtcccagcaccacaccacccctaaagtgccaggtgatctcctgtggctcatcggtggaagcagtggggtaggctgctgccctgctgtggaagaggagcaacaatcagacatgagtccaccctttggagaccaggcctcagctcttggtgggcccagggacacccacacaggtggccatcacagccccatggacaacactaattgtccacagcaaagggcaaggaatcctctgggagcttcttccgtttcttccccccagatacccatcttgaaaaacactatttctggaatgcttctgcatcaaaggagattctttgagatagcccatcttcctgagctagcaaatacaggagttttcactttctttaggaaagagaagctttcaggggaaggagagaatgattttgctgacttcccaagccctggtgaccagaccaaggcagggcccagcataattcctccagttggatgaacattcaagagagctcgttcctacctggctggagaccgaggccagaaggcaaaaaccagaaagggaacagtccataacttacctctgcttctgaccgatggtgtttgggaataggttactttggactgagtttgggttctctgctgtcctaagaacttcagtgtagagaaaataagacttctggtgctgctggggtatgttctgggcttaattcccccaagcagaagaccagatccaagatgtttggacaccctgtcagacgttggtcccaagtttaattagatttctgaatctcgttgaggccaaggaatgatccatactgaaaaaatgctgagccagccatctttggcaaaggtccctgagctcttgctatctctcaagagtgctgagaaccacggtgaaagtgctgctctaggcccacaagtgtaactatgctgttaacagctgtcaatagataattaaaattcatactgtatgaa

SEQ ID NO: 164437 - DNA, 1820 bp, Homo sapiens
  Payload ID: 12395
  Gene Symbol: PPHLN1
  Gene Name: periphilin 1
  ENST ID: ENST00000256678
  CDS Start-End: 182-1273
acctgggataacggcggcgagcggacggctgcatttacggggtctcccggagggccagagtcggtgggacgagagactgagaaaagaaataagacacagagacaaagtatagagaaagaacagtgggcccaggagaccaacacttagcatatggaggacctgcaccggcaccagtctggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcacacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactccgcatgggacttg

SEQ ID NO: 164438 - DNA, 1359 bp, Homo sapiens
  Payload ID: 12395
  Gene Symbol: PPHLN1
  Gene Name: periphilin 1
  ENST ID: ENST00000317560
  CDS Start-End: 99-1010
ataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagctggcgctgatacaatacaatgtttacctggccaaagagggttcgaggggacaagctggcctcacaataagatgcacagtgttagctaggtcatcgtgacaggcatgcctcacaccaagacggactatcaagacctgagccgacctgacttacataaatgacaaacactagtgctttacaaaggtggctggagttctccatcttctaaaatcaacatccaatccccttcagtcagcatcttcagtattcccttgaggactggaaaaccaaagcagctacgtccatctgtaacgcacccgcaccggacaggcacgagatgtcacgtccacctggcaccatccaaagagggtaaattggagaaatcacacctttcaaatgttaatctgacactgtaaacagcagttgagttctcatttacatgggcaaagaaagcacttt

SEQ ID NO: 164439 - DNA, 1465 bp, Homo sapiens
  Payload ID: 12395
  Gene Symbol: PPHLN1
  Gene Name: periphilin 1
  ENST ID: ENST00000337898
  CDS Start-End: 106-1128
attgcgcgcgccggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcaaaccttgaaacagccctcattaagtctactctcgagccggccctgtgtgccttttttctttgacttcagtaattgctaaatcaatgtacacattctatttttatcacacatatttgagcccacagctcactgcctgacccactggcttatggcaatgatcaagcagacctgcaggttatgatgtcactgcttaaccaagccacccaatcacatcaatttttccaccaaaattagagaaacttaactaaacaatgtcaacttacccagagactagctaaacaaattatcctgcaatgcccagattgccagctcacaggcacgtcccctccttcaacaggtgttaaccctagaggactagaacctaatcagttatggcaaacagatgttacacatgtccctg

SEQ ID NO: 164440 - DNA, 1643 bp, Homo sapiens
  Payload ID: 12395
  Gene Symbol: PPHLN1
  Gene Name: periphilin 1
  Uniprot ID: Q8NEY8
  ENST ID: ENST00000358314
  CDS Start-End: 94-1197
ggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctt

SEQ ID NO: 164441 - DNA, 2170 bp, Homo sapiens
  Payload ID: 12395
  Gene Symbol: PPHLN1
  Gene Name: periphilin 1
  Uniprot ID: Q8NEY8
  ENST ID: ENST00000395568
  CDS Start-End: 85-1461
tacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactccgcatgggacttgtccaaaaaaactctaatcaaaagaggaaaattttggaatatgccaggaatagtggaattttattttttaaatttttttataggcccatatgctctatctcaagaaacaagatgattgtaacatgtccatgattaaactattggcagattattgctgtgttaa

SEQ ID NO: 164442 - DNA, 1693 bp, Homo sapiens
  Payload ID: 12395
  Gene Symbol: PPHLN1
  Gene Name: periphilin 1
  Uniprot ID: Q8NEY8
  ENST ID: ENST00000395580
  CDS Start-End: 128-1252
attgcgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggt

SEQ ID NO: 164443 - DNA, 1583 bp, Homo sapiens
  Payload ID: 12395
  Gene Symbol: PPHLN1
  Gene Name: periphilin 1
  Uniprot ID: Q8NEY8
  ENST ID: ENST00000449194
  CDS Start-End: 83-1129
cctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatcttagagaata

SEQ ID NO: 164444 - DNA, 3377 bp, Homo sapiens
  Payload ID: 12395
  Gene Symbol: PPHLN1
  Gene Name: periphilin 1
  Uniprot ID: Q8NEY8
  ENST ID: ENST00000432191
  CDS Start-End: 73-1377
cggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactccgcatgggacttgtccaaaaaaactctaatcaaaagaggaaaattttggaatatgccaggaatagtggaattttattttttaaatttttttataggcccatatgctctatctcaagaaacaagatgattgtaacatgtccatgattaaactattggcagattattgctgtgttaatctctgtagtctaatgagttctttgttctgttctgctgccttttacgttttcttgtcctttcaaaagtgttcttgaaagaaacaaagcgaataggcagttagcacagcacagctaccccttaccaagcagtctatggaaacaacccctcatccaaatcatgggttagttaagaatctaactggggcaattaagatgaattccactcacttcctggtcacttcagcagcccagcggcattgagccaaaatatacaattctgtgttattagtgaggaaactttaaaactcatgtttgttattacttactacccaatttcattatcctcccttcctctttccatttctattctctctcacttgaattctggcattatttttagtggcctctactgataatacctaccctagagtacataaaaattatattaaaagaggaagtagcagtatgcataattttaacagattctataatgggtgcctcaaaatatgtattgtgccattccgcaaatttaaaagctaattgaggacaatttttttttaatttcctaaatgagaccaccttggatttttatttttgccatttagatgtttatacttatttagcttttataaaacataagccaagctaaatcccacataacaactctggtattcttccctcatatgagcagtgattttatttgttacccaccttagatagactaagaaagttctagtcttgtttctccttctccccgcttccctggggtttttccttaccataagtattctggtccgagggttcagttcctttagtcaagatgtcacaagtttaaaaacaaaacttgagaaactaccaaaggctcaggagttgtccactttgttgaaatccattaaattagagaagtctcactaacagatgtatttaaatataggtacaacaaataatttctttttctccccttccccaaattacagtcagcatttaaagctgtttatggcttgccatcagcattattctggtaggcttgttagtgttaaaatctatttgattttttttttttttttttgcctcttaaagtctaattttaggatggatgaattcagatgtttaccagagtgtgtattttacataatgttcttgattaaaaagacttgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagcaaccacatttaa

SEQ ID NO: 164445 - DNA, 1777 bp, Homo sapiens
  Payload ID: 12395
  Gene Symbol: PPHLN1
  Gene Name: periphilin 1
  ENST ID: ENST00000549190
  CDS Start-End: 182-1339
ggcgagttagccggcgggcggtgcgggggtggccgcggtggccgcggctgcctcgggcgccggcgccgcctctccgcgctgttcccccgttgcccccttggtacccccggctgccggggactgcctcgcgctccagagcccctctgaggaggaaaacgtctgtcccaccgactggcaggggatgctccgtcatcccgtgcgaagcctggtccaagtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatacttt

SEQ ID NO: 164446 - DNA, 560 bp, Homo sapiens
  Payload ID: 12395
  Gene Symbol: PPHLN1
  Gene Name: periphilin 1
  ENST ID: ENST00000552429
  CDS Start-End: 86-409
ctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagtagagatggggtttcgccgtgttagccaggatggtctccatctcctgacctcgtgatctgcccgtctcggcctcccaaagtgctgggattacaggcggacatgagagatggctttagaagaaaaagtttctactcttcccattatgcgagagagcggtctccttataaaagggaca

SEQ ID NO: 164447 - DNA, 176 bp, Homo sapiens
  Payload ID: 12395
  Gene Symbol: PPHLN1
  Gene Name: periphilin 1
  ENST ID: ENST00000551658
  CDS Start-End: 66-176
ccttagctctctgggtcgataccagtttttatgtttttgacacactgtcaccaaaagacgttggaatgactcagaaacaccaatatttcattcaagaatcagatggctacaatagactagttaatattgtgccaaagaaaccaccactgctagacagacctggtgaaggaagctac

SEQ ID NO: 164448 - DNA, 1095 bp, Homo sapiens
  Payload ID: 12395
  Gene Symbol: PPHLN1
  Gene Name: periphilin 1
  Uniprot ID: Q8NEY8
  ENST ID: ENST00000552761
  CDS Start-End: 102-1061
gggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaaca

SEQ ID NO: 164449 - DNA, 576 bp, Homo sapiens
  Payload ID: 12395
  Gene Symbol: PPHLN1
  Gene Name: periphilin 1
  ENST ID: ENST00000547847
  CDS Start-End: 72-576
agtaccatcgaaactgcactgatatgaggagatgtagtgatgatgtggcagtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaac

SEQ ID NO: 164450 - DNA, 588 bp, Homo sapiens
  Payload ID: 12395
  Gene Symbol: PPHLN1
  Gene Name: periphilin 1
  ENST ID: ENST00000546750
  CDS Start-End: 105-588
aacttttctggagtaccatcgaaactgcactgatatgaggagatgtagtgatgatgtggcaggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctact

SEQ ID NO: 164451 - DNA, 415 bp, Homo sapiens
  Payload ID: 12395
  Gene Symbol: PPHLN1
  Gene Name: periphilin 1
  ENST ID: ENST00000551723
  CDS Start-End: 110-268
acctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaa

SEQ ID NO: 164452 - DNA, 1449 bp, Homo sapiens
  Payload ID: 12395
  Gene Symbol: PPHLN1
  Gene Name: periphilin 1
  Uniprot ID: Q8NEY8
  ENST ID: ENST00000619544
  CDS Start-End: 145-1449
cgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 164453 - DNA, 1863 bp, Homo sapiens
  Payload ID: 12395
  Gene Symbol: PPHLN1
  Gene Name: periphilin 1
  Uniprot ID: Q8NEY8
  ENST ID: ENST00000613154
  CDS Start-End: 145-1191
cgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatcttagagaatatttgctttgagagtaattctcattcaatgataaaatagagcacttaaatctctgagagatacctcagaaaaaaatccgtttttccaagtaatgaactcagtgtcttctattacaataatcctgaaactcctgactctctcactgatgtatgagtcttaaataatatcatatacaagactaataaatagaagatgcagtttgaggtggaaggtgaggga

SEQ ID NO: 164454 - DNA, 1521 bp, Homo sapiens
  Payload ID: 12395
  Gene Symbol: PPHLN1
  Gene Name: periphilin 1
  Uniprot ID: Q8NEY8
  ENST ID: ENST00000610488
  CDS Start-End: 145-1521
cgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 164455 - DNA, 6238 bp, Homo sapiens
  Payload ID: 12396
  Gene Symbol: PPL
  Gene Name: periplakin
  Uniprot ID: O60437
  ENST ID: ENST00000345988
  CDS Start-End: 91-5361
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtgtgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccgggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgtccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagaagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctcccttgccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcactggtatttaggtatacaaaacagttgattattcaccacgccaatatctgggtctctgtatctcatgtagaacataagaaaatgggaactaatagggaaatttatttatagcatgaaaataaacctggtggctggagtctgcttgtacggtc

SEQ ID NO: 164456 - DNA, 5845 bp, Homo sapiens
  Payload ID: 12396
  Gene Symbol: PPL
  Gene Name: periplakin
  ENST ID: ENST00000590782
  CDS Start-End: 20-5284
ccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtgtgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccgggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgtccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagaagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctcccttgccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaa

SEQ ID NO: 164457 - DNA, 3615 bp, Homo sapiens
  Payload ID: 12396
  Gene Symbol: PPL
  Gene Name: periplakin
  ENST ID: ENST00000592772
  CDS Start-End: 270-3615
atgacaccaggatttggaagccaggagattcccattggtgatggggagtggaggctcatggaggtgaagtgacttgccccacagtcactcagctcgtcaattggggagctagaatatgaccctaagccagttcctgcctctttgctgtcctagaaccatctgcctgtaacagcacaagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggcccagaagtccctcctgggtgaggtggagcagaacttgcaggcggccaagcagtgctcgagcacactggccagccgcttccaggagcactgtccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagaagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgact

SEQ ID NO: 164458 - DNA, 6808 bp, Homo sapiens
  Payload ID: 12397
  Gene Symbol: PXDN
  Gene Name: peroxidasin
  Uniprot ID: Q92626
  ENST ID: ENST00000252804
  CDS Start-End: 52-4491
agccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatagacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatgga

SEQ ID NO: 164459 - DNA, 720 bp, Homo sapiens
  Payload ID: 12397
  Gene Symbol: PXDN
  Gene Name: peroxidasin
  ENST ID: ENST00000425171
  CDS Start-End: 48-720
ggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatca

SEQ ID NO: 164460 - DNA, 2643 bp, Homo sapiens
  Payload ID: 12397
  Gene Symbol: PXDN
  Gene Name: peroxidasin
  ENST ID: ENST00000433670
  CDS Start-End: 1-2171
ccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagtcagtgccaaagccttttcttcctcctccatggcctgagtaacggggttgaacacgcctcagttaagtcacattcctagggaagagttccagcattttctttcccactgtgcttatgaactgtgaaattatttccttaaactgtgattcctcttgagccctacagccctgtcgctctcactttggtttaataggaatctctgggggacgtgaagtcccttggagtgctgatcaggctacagcaggtccacctgccctgagtgggttatgccatcctggccagggtgggttatgcaagcccagtccctctgcaacaaatgagccataagggaggacttggcagcgtgcttgctccctgagtgacgttgtgtcctgggaatgcggtgccacgcgtattaggagggttgttttggaagagtcccgggtctgtgaaaccagctgatgagatcacctcgggctggtgtggagatgctgttgggggaggtatgtcccccactcactctgctctggcactttgccgttgcccagtaaataacagatgcctttacatgt

SEQ ID NO: 164461 - DNA, 588 bp, Homo sapiens
  Payload ID: 12397
  Gene Symbol: PXDN
  Gene Name: peroxidasin
  ENST ID: ENST00000447941
  CDS Start-End: 1-588
tggaagctggttcccttctgcaccaggactgagcacaacggtgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccc

SEQ ID NO: 164462 - DNA, 740 bp, Homo sapiens
  Payload ID: 12397
  Gene Symbol: PXDN
  Gene Name: peroxidasin
  ENST ID: ENST00000453308
  CDS Start-End: 1-229
ggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattgg

SEQ ID NO: 164463 - DNA, 4805 bp, Homo sapiens
  Payload ID: 12398
  Gene Symbol: PXDNL
  Gene Name: peroxidasin-like
  Uniprot ID: A1KZ92
  ENST ID: ENST00000356297
  CDS Start-End: 102-4493
agtccagcagccaccatcaccaccactgcggttgctgctgcagctgcagctgctgctctccctccggctgcttcttcgcgtggccagcagcgaatggagcgatggagcccagactgttctgctggaccactctctttctcctggccgggtggtgcctgccagggttgccctgccccagccggtgcctttgctttaagagcaccgtccgctgcatgcacttgatgctggaccacattcctcaggtaccacagcagaccacagttctagacttgaggtttaacagaataagagaaattccagggagcgccttcaagaaactcaagaatttgaacacacttctgctgaacaacaaccacatcagaaagatttccagaaatgcttttgaaggacttgaaaatttgctatatctgtacctgtataagaatgaaatccatgcactagataagcaaacatttaaaggactcatatctttggaacatctgtatattcatttcaaccaactagaaatgctacagccagagacctttggagaccttctgagattagagcgactatttttgcataacaacaaattatctaaaattccagctgggagcttttctaatctggattcattaaaaagattgcgtctggattccaacgccctggtttgtgactgtgatctgatgtggctgggggagcttttacaaggctttgcccaacacggccacacccaggctgcggctacctgcgaatatcccaggagactccatgggcgtgcagttgcttcagtaacagtagaggaattcaattgccagagcccccgaattacttttgagccgcaggatgtggaggtaccatcaggaaataccgtctacttcacctgccgggcggaaggaaaccccaaacctgagattatttggatacacaacaaccactcattggatttggaagatgatactcgacttaatgtgtttgatgatggcacactcatgatccgaaacaccagagagtcagaccaaggtgtctatcagtgcatggccagaaattccgctggggaagccaagacacagagtgccatgctcagatactccagtcttccagccaaaccaagctttgtaatccagcctcaggacacagaggttttaattggcaccagcacaactttggaatgtatggccacaggccacccacaccctcttatcacttggaccagggacaatggattggagctggatggatccaggcacgtggcaacgtccagtggactttacttacagaacatcacacaacgggatcatggtcgatttacctgtcatgccaacaatagccacggcactgttcaagctgcagcaaacataattgtacaagctcctccacaatttacagtaacccccaaggatcaagtggtgctggaagaacatgctgtagagtggctctgtgaagctgacggcaacccacctcctgttattgtctggacaaaaacaggagggcagctccctgtggaaggccagcatacagttctctcctctggcactttgagaattgaccgtgcagcacagcacgatcaaggccaatatgaatgtcaagcagtcagttcgttgggggtgaaaaaggtgtctgtgcagctgactgtaaaacccaaagctcttgcagtgtttactcaacttcctcaggatacaagtgtcgaggttggaaagaatataaacatttcatgtcatgctcaaggagaaccacagcccataattacttggaataaggaaggtgtgcagattactgagagtggtaaattccatgtggatgatgaaggcacgctgactatctacgacgcagggttccctgaccagggaagatatgaatgtgtggctcggaattcttttggccttgctgtgaccaacatgtttcttacagtcacggctatacagggtagacaagctggcgatgactttgttgaatcttccattcttgatgctgtacagagagttgacagtgcaattaactccacacgaagacatttgttttcacaaaaacctcacacctccagtgacctgctggctcaatttcattacccgcgtgacccactgattgtggaaatggcaagagcaggggagatttttgagcacacgctgcagctgatacgggaacgtgtgaagcaggggctcactgtggacttggaaggcaaagaattccggtacaatgacttggtgtccccgcgctccctcagcctcatcgccaatttatctggatgcacagctcgcaggcctctgccaaactgctccaaccggtgtttccatgcgaagtaccgcgcccacgacggcacgtgcaacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagataggttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagactgtaggagtagaggacagttcagagcagtgacgcaagagtctcaaaagaaacgctcagctcaatacagctatcctgttgataaggatatggagttaagtcatctaagaagtaggcaacaagataaaatatatgtgggtgaagatgctagaaatgtgacagttctggcaaaaacaaagttctcccaagatttcagcacgtttgcagcggaaattcaggaaaccatcacagcactcagagagcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaa

SEQ ID NO: 164464 - DNA, 1925 bp, Homo sapiens
  Payload ID: 12398
  Gene Symbol: PXDNL
  Gene Name: peroxidasin-like
  ENST ID: ENST00000522933
  CDS Start-End: 1-1613
atgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagactgtaggagtagaggacagttcagagcagtgacgcaagagtctcaaaagaaacgctcagctcaatacagctatcctgttgataaggatatggagttaagtcatctaagaagtaggcaacaagataaaatatatgtgggtgaagatgctagaaatgtgacagttctggcaaaaacaaagttctcccaagatttcagcacgtttgcagcggaaattcaggaaaccatcacagcactcagagagcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaa

SEQ ID NO: 164465 - DNA, 2258 bp, Homo sapiens
  Payload ID: 12398
  Gene Symbol: PXDNL
  Gene Name: peroxidasin-like
  ENST ID: ENST00000522628
  CDS Start-End: 1-1749
aacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagataggttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagataaacaagctggaggcacgcctgaggcaggcagggtgtacagatgttagaggggttccaaggaaggccgaggagcgctggatgaaagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaat

SEQ ID NO: 164466 - DNA, 1234 bp, Homo sapiens
  Payload ID: 12399
  Gene Symbol: PRDX1
  Gene Name: peroxiredoxin 1
  Uniprot ID: Q06830
  ENST ID: ENST00000262746
  CDS Start-End: 342-941
gactctcgcgagatccctactggctataaaggcagcgccccggagagctcttgcgcgtcttgttcttgcctggtgtcggtggttagtttctgcgacttgtgttgggactggtgagtgtgggcagtgcggcccctgcggagtgaggcgcggcgcgcccttcttgcctgttgcctcttcctcctcctgtccggggcccgcccgcgctcgggtgggggtgctgtgatgcgtgaggcagccgggggaggcccggagtccgagactgcttgagcgctgcgcacacccctctcgtgggccccccacgtaggtgcgggaacctggttgaaccccaagctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaccttgatgagtcttt

SEQ ID NO: 164467 - DNA, 609 bp, Homo sapiens
  Payload ID: 12399
  Gene Symbol: PRDX1
  Gene Name: peroxiredoxin 1
  ENST ID: ENST00000372079
  CDS Start-End: 38-331
agtttctgcgacttgtgttgggactgctgataggaagatgtcttcaggaaatgctaaaattgggcaccctgcccccaacttcaaagccacagctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgaga

SEQ ID NO: 164468 - DNA, 1021 bp, Homo sapiens
  Payload ID: 12399
  Gene Symbol: PRDX1
  Gene Name: peroxiredoxin 1
  Uniprot ID: Q06830
  ENST ID: ENST00000319248
  CDS Start-End: 140-739
ggcacccccgtccgttccgactctcgcgagatccctactggctataaaggcagcgccccggagagctcttgcgcgtcttgttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagacctt

SEQ ID NO: 164469 - DNA, 795 bp, Homo sapiens
  Payload ID: 12399
  Gene Symbol: PRDX1
  Gene Name: peroxiredoxin 1
  ENST ID: ENST00000424390
  CDS Start-End: 282-795
agaggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacaggctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 164470 - DNA, 606 bp, Homo sapiens
  Payload ID: 12399
  Gene Symbol: PRDX1
  Gene Name: peroxiredoxin 1
  ENST ID: ENST00000447184
  CDS Start-End: 93-606
gactctcgcgagatccctactggctataaaggcagcgccccggagagctcttgcgcgtcttgttcttgcctggtgtcggtgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 164471 - DNA, 987 bp, Homo sapiens
  Payload ID: 12400
  Gene Symbol: PRDX2
  Gene Name: peroxiredoxin 2
  Uniprot ID: P32119
  ENST ID: ENST00000301522
  CDS Start-End: 130-726
cgccgtgcacgtcttggttcgggccgggcataaaaggcttcgcggcccagggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgtga

SEQ ID NO: 164472 - DNA, 784 bp, Homo sapiens
  Payload ID: 12400
  Gene Symbol: PRDX2
  Gene Name: peroxiredoxin 2
  ENST ID: ENST00000334482
  CDS Start-End: 58-468
cgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgtga

SEQ ID NO: 164473 - DNA, 1591 bp, Homo sapiens
  Payload ID: 12401
  Gene Symbol: PRDX3
  Gene Name: peroxiredoxin 3
  Uniprot ID: P30048
  ENST ID: ENST00000298510
  CDS Start-End: 44-814
ccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 164474 - DNA, 852 bp, Homo sapiens
  Payload ID: 12402
  Gene Symbol: PRDX4
  Gene Name: peroxiredoxin 4
  ENST ID: ENST00000379331
  CDS Start-End: 21-581
gtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggtcagtatcttacacttatattcgtagaaaaaaaagaatggatttactcttaaagcatggacagataactcttgatatgatataagaatatagtcatttatcagacaattcaggaatagctttatctaagagtaatacatgtaactacacattttccaggttaaaaaaagagagaagagtaatataatcagctgctataataaaaatgcttaaggattttataggacatttcaaaataaggggaaaagttaaatgcaatagatgtgatttctatagcgaaaaccactgaattatatgcttatgataaattgggttaccataatctggaggaaaaaaatctttaaaatatgccattt

SEQ ID NO: 164475 - DNA, 1005 bp, Homo sapiens
  Payload ID: 12402
  Gene Symbol: PRDX4
  Gene Name: peroxiredoxin 4
  Uniprot ID: Q13162
  ENST ID: ENST00000379341
  CDS Start-End: 126-941
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattaccaca

SEQ ID NO: 164476 - DNA, 815 bp, Homo sapiens
  Payload ID: 12402
  Gene Symbol: PRDX4
  Gene Name: peroxiredoxin 4
  ENST ID: ENST00000379349
  CDS Start-End: 259-815
agggagctccaacagaactgagggacgaacagtaggtgcctgagagctggccgatctggtcactctctccagtgggccacaggggcccacttggtgggcagtctctgctgccagctagggcatctcagctcagcccagagcaaagacgtgtagggacataacgctttcctcaagcttcctttcccaggtccaaacttagaggcccagttttgggcctagaattcactgaggtttgtggctgtttgtccaacagtcaccatggatcaccgaagccgactacggggcacaggcctgaaccgaatccctgggactcagtcccgagccccccgagtcccactccccttccacgtgcaacaggaggccagggaaggagaagactgggagcgagagccacctcgtcagaggcctcctatctatgagccaccagaaagtgaagagctgccagataatgttatggtttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttag

SEQ ID NO: 164477 - DNA, 554 bp, Homo sapiens
  Payload ID: 12402
  Gene Symbol: PRDX4
  Gene Name: peroxiredoxin 4
  ENST ID: ENST00000439422
  CDS Start-End: 1-484
gtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaatcaaacctgaagataccatgaaagcctggtggccaagagagagctataatcccagatccagctggaaagctgaagtatttcgataaactgaattgagaaatacttcttcaagttatgatgcttgaaagttctcaataaagttcacggtttcattac

SEQ ID NO: 164478 - DNA, 893 bp, Homo sapiens
  Payload ID: 12403
  Gene Symbol: PRDX5
  Gene Name: peroxiredoxin 5
  Uniprot ID: P30044
  ENST ID: ENST00000265462
  CDS Start-End: 129-773
cgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 164479 - DNA, 596 bp, Homo sapiens
  Payload ID: 12403
  Gene Symbol: PRDX5
  Gene Name: peroxiredoxin 5
  Uniprot ID: P30044
  ENST ID: ENST00000352435
  CDS Start-End: 35-547
caggaggcggagtggaagtggccgtggggcgggtatgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgccca

SEQ ID NO: 164480 - DNA, 463 bp, Homo sapiens
  Payload ID: 12403
  Gene Symbol: PRDX5
  Gene Name: peroxiredoxin 5
  Uniprot ID: P30044
  ENST ID: ENST00000347941
  CDS Start-End: 35-412
caggaggcggagtggaagtggccgtggggcgggtatgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagc

SEQ ID NO: 164481 - DNA, 1751 bp, Homo sapiens
  Payload ID: 12404
  Gene Symbol: PRDX6
  Gene Name: peroxiredoxin 6
  Uniprot ID: P30041
  ENST ID: ENST00000340385
  CDS Start-End: 133-807
ccccgcccccgccgccccagtccccgcccctcgcgccttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 164482 - DNA, 4385 bp, Homo sapiens
  Payload ID: 12405
  Gene Symbol: PEX1
  Gene Name: peroxisomal biogenesis factor 1
  Uniprot ID: O43933
  ENST ID: ENST00000248633
  CDS Start-End: 97-3948
cgatcgatctcctccggctccgacgtcctcggcctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgatacaa

SEQ ID NO: 164483 - DNA, 734 bp, Homo sapiens
  Payload ID: 12405
  Gene Symbol: PEX1
  Gene Name: peroxisomal biogenesis factor 1
  ENST ID: ENST00000422866
  CDS Start-End: 1-590
aaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaaaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaa

SEQ ID NO: 164484 - DNA, 3681 bp, Homo sapiens
  Payload ID: 12405
  Gene Symbol: PEX1
  Gene Name: peroxisomal biogenesis factor 1
  ENST ID: ENST00000428214
  CDS Start-End: 1-3681
atgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgagctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataa

SEQ ID NO: 164485 - DNA, 3329 bp, Homo sapiens
  Payload ID: 12405
  Gene Symbol: PEX1
  Gene Name: peroxisomal biogenesis factor 1
  Uniprot ID: O43933
  ENST ID: ENST00000438045
  CDS Start-End: 7-2892
gggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacagattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgatacaa

SEQ ID NO: 164486 - DNA, 2871 bp, Homo sapiens
  Payload ID: 12406
  Gene Symbol: PEX10
  Gene Name: peroxisomal biogenesis factor 10
  Uniprot ID: O60683
  ENST ID: ENST00000288774
  CDS Start-End: 29-1069
ctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtaccaggcgctgaggccagatcccctcagggtcctgatgagtgtggcgccatctgccttacagctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcgcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctgcggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggtacaagaaaatccagacactaagcattcaccgtgtcaattctgagacaggaaacaccgcccagagtgaggagcctgcgcagcccggggcccaggaggagaggccttcactcgcatgtcagtgtctcatctgggaccacagctgtgatgttctgctgtgcaatatgggtcacctttcgaaaaggccaaacaaaaggtgggctttcctgtgtccagcgactgccatgttttaggtaaagactttagtaaaggtggaggtaaaatcacttggtaaaa

SEQ ID NO: 164487 - DNA, 1997 bp, Homo sapiens
  Payload ID: 12406
  Gene Symbol: PEX10
  Gene Name: peroxisomal biogenesis factor 10
  Uniprot ID: O60683
  ENST ID: ENST00000447513
  CDS Start-End: 70-1050
atcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaa

SEQ ID NO: 164488 - DNA, 907 bp, Homo sapiens
  Payload ID: 12406
  Gene Symbol: PEX10
  Gene Name: peroxisomal biogenesis factor 10
  ENST ID: ENST00000510434
  CDS Start-End: 34-663
cgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctg

SEQ ID NO: 164489 - DNA, 1941 bp, Homo sapiens
  Payload ID: 12406
  Gene Symbol: PEX10
  Gene Name: peroxisomal biogenesis factor 10
  ENST ID: ENST00000507596
  CDS Start-End: 39-1013
gccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaa

SEQ ID NO: 164490 - DNA, 548 bp, Homo sapiens
  Payload ID: 12406
  Gene Symbol: PEX10
  Gene Name: peroxisomal biogenesis factor 10
  ENST ID: ENST00000514502
  CDS Start-End: 13-234
gaacccgcggccatggccccggccgccgccagccccccggaggtgatccgcgcggcgcagaaggacgagtactaccgcggtgggctgcggagcgcggcgggcggcgccctgcacagcctggcgggacttattactcttctgatagatgagcaaattgagattccagaaagacctcacagccagcaagttggagagctgctttttgatgctagacagttggcctctggcctgtaatcttaataccccagaccatctttccatgtggccctcataggccctagaacagttgctcaggggaatcccggagcaagagatgagcacaggtgggagattcttcgcagactgtctgcagctcacgctaaggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcat

SEQ ID NO: 164491 - DNA, 653 bp, Homo sapiens
  Payload ID: 12406
  Gene Symbol: PEX10
  Gene Name: peroxisomal biogenesis factor 10
  ENST ID: ENST00000502666
  CDS Start-End: 1-78
gagattccagaaagacctcacagccagcaagttggagagctgctttttgatgctagacagttggcctctggcctgtaatcttaataccccagaccatctttccatgtggccctcataggccctagaacagttgctcaggggaatcccggagcaagagatgagcacaggtgggagattcttcgcagactgtctgcagctcacgctaaggtgcgaggaagtggctggagtggaggaaggaggttgagctgctctcagatgtggcctactttggcctcaccacacttgcaggtagaagctcccacgggacctcaggactgagggcagccacacacaccaagtctggggacggtggccagggggctgccaggcagtgtgagaagctcctggagctggcccgggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacgg

SEQ ID NO: 164492 - DNA, 611 bp, Homo sapiens
  Payload ID: 12406
  Gene Symbol: PEX10
  Gene Name: peroxisomal biogenesis factor 10
  ENST ID: ENST00000508384
  CDS Start-End: 522-611
cccacagctgagctcctgtagatggaaccagaggtgaggcaaggaactggaggccctccccactgaggtcagcggggcgcagacgcccccttgtcgtgccctgccttcctcctgcaatcctgcaggactctccagggccaagtgctgcccttggggccaaaaaacagggccttctccttcacctgccctgcagccattcaggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctc

SEQ ID NO: 164493 - DNA, 2740 bp, Homo sapiens
  Payload ID: 12407
  Gene Symbol: PEX11A
  Gene Name: peroxisomal biogenesis factor 11 alpha
  Uniprot ID: O75192
  ENST ID: ENST00000300056
  CDS Start-End: 151-894
agaaagtgtgcccgccccctctggggcggagagactcagcccctccccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagagccactcagtacacatgcatgttgcttagatatttgttagagcccaaagctggcaaagagaaggtggtaatgaagctcaagaaactggagtccagtgtgagcactggtcgtaaatggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagcctggtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaatttaaaaagacccaatcgcactgatcattgaacaccagtatacaataactttagggtcatatggatcattggtttcacgattacagtaggtctggtgcatggcactctcagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaactgaggctagagcctcattcctctgactcctaatccagtgttctctccatgctctcccactgtcttcagaattgagtagaaatgtgatcccctcctgaatcctgttttttgcctcttactctcccataatttggaaatttccttgtccagtggtttatattcttttctagaaaaactaaaactgggtggagtgtggtggctcacacctataatcccagcactttgggaggctgaagcggaaggattgcttgaggccaggagttcaagaccagcctgggcaatgtagtgagactccttctctacaacaaagtgttaaaaaattagccaggcatggtggagtatgcctgtagtcccagatactctggaggctgaagcaggaggatcacttgagcccaggagttcaaggctgcagtgagcttccaccgcactccagcccgggtgatagagcaagaccctgtgtcttaaaaaaaaattaagacagtatttagacttatcagttagattgttttatttaaatccttctaacaatttaggcaattctacattaattttcatcaaaatttatccagtcaaaaaaatttcatgaatactccagatgtaagagagtcacaattttctacgataaatcagacatcttatttctagggtgattgagggaggtggaaagcgcaggaggaagccagtgaagaggacaatggaatgctgagtcaatgacattgacttgtgttcctatctgccatcttgggtgtgggtctttatatgtggttacagatcctttagtttgagggaggtgaggtagagaaataggatgccagcaggtaggaggccgatgtcagtcctcccagcaaagctgtgtcatttatctgaatggaaatgagaaaataaatatgtactcaataagtcacatttcccagaaatgtgattgagattctcaaaaaatagactcagattcttggctgtctgtttaaccaatcacgatatgggatttgagaaataaaatttagggaattttaagagacatgaaagctactaggtcagggaaaataaaaagcttaaataactatttttattgtccagatcctctactgtaatagattaactatgttcaataaatttctagacaaaattga

SEQ ID NO: 164494 - DNA, 978 bp, Homo sapiens
  Payload ID: 12407
  Gene Symbol: PEX11A
  Gene Name: peroxisomal biogenesis factor 11 alpha
  Uniprot ID: O75192
  ENST ID: ENST00000561257
  CDS Start-End: 31-681
gtgcgactcgtggcctttgggctagaagccatggacgccttcacccgcttcaccaaccagacccagggccgggaccgactcttcagagccactcagtacacatgcatgttgcttagatatttgttagagcccaaagctggcaaagagaaggtggtaatgaagctcaagaaactggagtccagtgtgagcactggtcgtaaatccaacctgaaccgtgtgatttatttcatctgtgacaccatcctctgggtgaggagcgtaggtctcacctctggcatcaacaaagagaaatggcgaacgagggctgctcaccactactactattctcttctgctgagcctggtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaat

SEQ ID NO: 164495 - DNA, 529 bp, Homo sapiens
  Payload ID: 12407
  Gene Symbol: PEX11A
  Gene Name: peroxisomal biogenesis factor 11 alpha
  ENST ID: ENST00000561224
  CDS Start-End: 122-316
agagactcagcccctccccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagagccactcagtacacatgcatgttgcttagatatttgttagagcccaaagctggcaaagagaaggtggtaatgaagctcaagaaactggagtccagtgtgagcactggtcgtaaatacaaaattgacttgtgtctgtgagtgtgttctgggaagagagaagagttaaacataaggcaatccatcagataatcctcaatcagcctacacagttggtacagcgagctctgggctagaagatccaggctgaggaggaggatggagaaagattgagatgtagagcctctgggttgagagggacctctgaaatgaactcatctagactgctgccatggagatggtgctctacagtag

SEQ ID NO: 164496 - DNA, 905 bp, Homo sapiens
  Payload ID: 12407
  Gene Symbol: PEX11A
  Gene Name: peroxisomal biogenesis factor 11 alpha
  ENST ID: ENST00000559170
  CDS Start-End: 152-250
cagaaagtgtgcccgccccctctggggcggagagactcagcccctccccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagcctggtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaac

SEQ ID NO: 164497 - DNA, 1740 bp, Homo sapiens
  Payload ID: 12408
  Gene Symbol: PEX11B
  Gene Name: peroxisomal biogenesis factor 11 beta
  Uniprot ID: O96011
  ENST ID: ENST00000369306
  CDS Start-End: 150-929
ttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcga

SEQ ID NO: 164498 - DNA, 667 bp, Homo sapiens
  Payload ID: 12408
  Gene Symbol: PEX11B
  Gene Name: peroxisomal biogenesis factor 11 beta
  ENST ID: ENST00000428634
  CDS Start-End: 1-246
ccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattgaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcga

SEQ ID NO: 164499 - DNA, 1632 bp, Homo sapiens
  Payload ID: 12408
  Gene Symbol: PEX11B
  Gene Name: peroxisomal biogenesis factor 11 beta
  Uniprot ID: O96011
  ENST ID: ENST00000537888
  CDS Start-End: 85-822
aactccggctacgggggcccgaacggaccgtgaggcgcagatttgagccgctgttgagatgattcctttccgttcgcggaagagatggggaaactgagggccgcccagtatgcttgctctcttcttggccatgcgctgcagaggcatggagccagtcctgagttacagaaacagattcgacaactggagagccacctgagccttggaagaaagcttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcg

SEQ ID NO: 164500 - DNA, 1062 bp, Homo sapiens
  Payload ID: 12409
  Gene Symbol: PEX11G
  Gene Name: peroxisomal biogenesis factor 11 gamma
  Uniprot ID: Q96HA9
  ENST ID: ENST00000221480
  CDS Start-End: 10-735
ggagttgccatggcgtcgctgagcggcctggcgtcggcgctggagtcgtacaggggccgggaccgcctgatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcaatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctggc

SEQ ID NO: 164501 - DNA, 1345 bp, Homo sapiens
  Payload ID: 12409
  Gene Symbol: PEX11G
  Gene Name: peroxisomal biogenesis factor 11 gamma
  Uniprot ID: Q96HA9
  ENST ID: ENST00000593942
  CDS Start-End: 504-1019
ggcaggcttggtgcgaatactgcctccttagagctccaggaacccagttcttagctgtgatggatccttgcaatgaaagaattaagaagggcgggtgcggtggttcacgcctgtaattccagcactttggaaggtcgacgtgggaagattgcttaagcccagggctcaaggccagcctgggtaacatgaacaattcttaacgtccaaagataacgtctttccttaacgtcgaaagatgccttgttgtgatattacagcagtcattcctgctcactacgggcaggcagacagtgcagaaaaggtgaagcacaaaaactaaaaaggaaaatctctccttgaaccactgcgaacagatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcaatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctgg

SEQ ID NO: 164502 - DNA, 806 bp, Homo sapiens
  Payload ID: 12409
  Gene Symbol: PEX11G
  Gene Name: peroxisomal biogenesis factor 11 gamma
  ENST ID: ENST00000593547
  CDS Start-End: 1-505
gtacaggggccgggaccgcctgatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacggg

SEQ ID NO: 164503 - DNA, 2675 bp, Homo sapiens
  Payload ID: 12410
  Gene Symbol: PEX12
  Gene Name: peroxisomal biogenesis factor 12
  Uniprot ID: O00623
  ENST ID: ENST00000225873
  CDS Start-End: 609-1688
ctctcttccgccaggcatcccagaggtcctggtggtttcatttccgggtgcggcttctgtcataaagcggagacctcccttcaaacgtggcgtcgtgggttgtttgcgcctcgcctggggtcagcgagcaaggacgggcgcgggcggggatactcaaagccaacagctggagtcagcccttgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagacta

SEQ ID NO: 164504 - DNA, 897 bp, Homo sapiens
  Payload ID: 12410
  Gene Symbol: PEX12
  Gene Name: peroxisomal biogenesis factor 12
  ENST ID: ENST00000585380
  CDS Start-End: 235-897
agacgtctgcgcggtgccccaaacagcttgtcaaaaagacctcgcagagagaggttcagagctgtagctttccagcgaggctaccatgcagacccagctacgaaaagtaaaccaaactagccaaaaccagcccacaagggccctcttctgtttcagcggggcgggagcggaagctcagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatg

SEQ ID NO: 164505 - DNA, 1607 bp, Homo sapiens
  Payload ID: 12410
  Gene Symbol: PEX12
  Gene Name: peroxisomal biogenesis factor 12
  ENST ID: ENST00000586663
  CDS Start-End: 532-1607
ccttcaaacgtggcgtcgtgggttgtttgcgcctcgcctggggtcagcgagcaaggacgggcgcgggcggggatactcaaagccaacagctggagtcagcccttgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaa

SEQ ID NO: 164506 - DNA, 2682 bp, Homo sapiens
  Payload ID: 12410
  Gene Symbol: PEX12
  Gene Name: peroxisomal biogenesis factor 12
  Uniprot ID: O00623
  ENST ID: ENST00000613219
  CDS Start-End: 617-1696
tagagcgcctctcttccgccaggcatcccagaggtcctggtggtttcatttccgggtgcggcttctgtcataaagcggagacctcccttcaaacgtggcgtcgtgggttgtttgcgcctcgcctggggtcagcgagcaaggacgggcgcgggcggggatactcaaagccaacagctggagtcagcccttgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagact

SEQ ID NO: 164507 - DNA, 4470 bp, Homo sapiens
  Payload ID: 12411
  Gene Symbol: PEX13
  Gene Name: peroxisomal biogenesis factor 13
  Uniprot ID: Q92968
  ENST ID: ENST00000295030
  CDS Start-End: 39-1250
tcaggggtaggagcgggagccgagaggaggcggaggagatggcgtcccagccgccacctccccccaaaccctgggagacccgccgaattccgggagccggaccgggaccaggaccgggccccactttccaatctgctgatttgggtcctactttaatgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagtatgttggtctggtgacctggttacattttattatacacattattggaccataaggacatttgtttcacctagattttaagattatggagactgctgtcatttttatcttatttaaatctctaggtttattggaagagtaagattgatgaactatagcatgcacagtttggtacagtagagatcattaatacttttaaaagttctgcattaattgacttggaatccttagaaatggagtggtgacatgtcagtatgagaacaggcaaaaggtaaatttttttttttttttacaaccttaagtaatctcaataataaaattttctgatctgtattatatccagtgttgggtttatattttcacccacaaacaactgacactgctatcttttactgtatttttaaaaatttaatttgaaaaggtcacccagaagcattctgaaggaaatggttctagaattatagagtatgtagccctaatagttttccctcctagcaaaaagtctgaaatttatctttcttacaaactgttccatttcttctaaggatcccttaattatttatctctttaagccaggcatggtggctcacgcctgtaatcccagcactttgggaggctgaggcgggcagatcacctgaggttgggagttcaagaccaccctgaccaacatggagaaaccccatctttacgaaaaatacaaaattagctaggtgtggtggcacatgcctgtaatcccagctactcgggaggctgaggcaggagaattgcttgaaccccaggaggcggaggttacgctgagccggagatctcgccattgcacttcagcctgggcaacaaaagcgaaactccatctcaaaaaataaaattatttatttctttaaaatatgactagttttcatactgggtgaatcagaagtatatgaaaggtatactttcttttcctacaacaaatacttgagttcttttgagtttgcacttaatgatataatcagttataatagtaatttttaatattttcatagattgtttgcttctaccttgtgtaattttttaaattccatatttaggatgctctgtaaatattgaaaatgtgtcacattggatacatttttcttttaggtttagtttttactactgagacttatttatagtcttagtgctctattgccatttagaatatgataatcctcatgcctttaatctcagcactttgggaggccaaggcgggcggatcacctgcggtcaggagtttgagaccagcctggccaacacggtgaaaccctgtctctactaaaaatacgaaaattagctgggtgcagtggcgtgcacctgtagtcccagctactcaggaggctgaggcaggagaatcacttgaacccgggaggcagaggttgcagggagctgagatcatgccactgcactccagcctaggggacagagcaagactctgtctcaaaacaaacaaacaaaaaataataatacgataatgctatttgacgtgttttttggtttataatgattttaaatgcagttaactttcagtacactgaatatttccccagaaaattggaaacttcatatacttggctacgaacatactacagagtaatactatcaggaatacaggtgtataagaatacatttatagatattgttgaaaactttgaactgtttgataaaaattgtgatttagtattttttcttttgtctttttttgaaacggagtctcactctgtcgcccaggctggagtccagtggcgcgatctcggctcactgcaagctccgcctcccgggttcacgccattctcctgcctcagcctcccgagtagctgggactacaggcgcctgccaccaggcccggctaattttttttgtatttttagtagagacggggtttcaccgtgttacccaggatggtctccatctcctgacctcgtgatgagcccgcttcggtctcccaaagtgttgggattacaggcgtgagccaccgcacccagcgatttagtatttttttctaatagactatgttcaacaaataagtaattctcgaatagttcagattaaaacatacaggaaccaagtacatacccagcatagaagaactttactaaaggcttcttggaaagcccttttttgaaacgacagtatcgtaagtaacatatcatttataatagaaatcttgacccagtgcagaaaaataaatatagtaaaatttatttatctttggccagttttccaacacccaggtattagccttgaagttgaagagataaggtttcttgtatattatttttcatttgtgttctacaattaaaggttctgctttgatttgtcagataatttatagaaattttgttctcaaaacaaatgtttgataaaacagattattaaatttggggttgagatgtctaaattgaatgctagaagtaaagtagaagtgaccactattaaagatgtatagggagaagagtacagcacaaagtgataaaatagtgacacttttgtaggggtgtttattgtttggttaagtctgctaaattacggtatgcattatctggtgactatttgtgcctgaaaattcgttttgtattaaaattctggagaaggaattcaggactagaataaagagaaattttgtaaccttttttatcatgacagttttagaataatttttttagctgagattaaatgttcaaggctccaatattatttttaggaacttatttaaggagtgctactttacagaaattactaacacaccaaaacattattaattaaataaaatataagtttacaataataaaacatgtttcttttaatttttctgattatattttatgagttcagaaaggaaatggtaaaagaactatacattttcatgttttaacattttatgtacgtacttgattctgtctgtgtcataattacacatttacttgaacacagctatcctttatcttgtgctttctttaatagaaaaatgaacagaaactgaatgcagttaaatttttatttttagtaggttgtgaagttacttttactggagaaataaaaatatgttaaacttga

SEQ ID NO: 164508 - DNA, 1108 bp, Homo sapiens
  Payload ID: 12411
  Gene Symbol: PEX13
  Gene Name: peroxisomal biogenesis factor 13
  ENST ID: ENST00000401576
  CDS Start-End: 119-229
gtttcttcctacaaattagtggcatcctcccgctgtatggattcagctggcaaagtgctggtctacgcgggcctggacagtcaggggtaggagcgggagccgagaggaggcggaggagatggcgtcccagccgccacctccccccaaaccctgggagacccgccgaattccgggagccggaccgggaccaggaccgggccccactttccacgtagactttggtctgtagcagttgagagcggcatttgtccagccacggcatcgacagggagcaaagtctctccttaaaggtgttaacctctcgagaagttgctgaaagccggaaaggttttacgcaacaggaactcaagccccgtacactttgcattcttttccagcataactcagccagtgtttcggatcgagattggagaagcaactttaaagcaggagttctagatctgaggcctatggatggactttgtgtgcaaaatagtgtatttttctgaggcctgtattttttttttgtttggtttttaatcagtatcagttggtttctaggactttaaaaaggctaaaacatgcagagttgggagtgtttcgtggcctcgtgtggcttttgtttggtagtgctggacatcttaattcagataggtgtgattcaaatgtcaaatcacctactattgtaggttttcctaagcgtaaaaaccccaacatattggaatgtatttctgctgtattctgaaatcttttatttaaacactaaaatgctttaacacagtaacgacttagtttaataaggatatatacataacaagtaataagtttgattaggctggtaagccacggtgacattatctgctaccttttttttgagtgggttcttttttccccatttaggctgcttgtcgaatgagagaggttttattttttgcatctgttaaagttctttttatgtaaaattaaccattttcccactttatcgtgaaatattttaaacacagagaccagtagagagtaagataatacctatatattcactactcaactttaaacagtgttaacatttgccagacttatgtcgaatttttcaaaataaaagacggctaaactctcccattcttcttta

SEQ ID NO: 164509 - DNA, 1533 bp, Homo sapiens
  Payload ID: 12411
  Gene Symbol: PEX13
  Gene Name: peroxisomal biogenesis factor 13
  ENST ID: ENST00000444100
  CDS Start-End: 536-727
aagacaacgcacctattgcgtctagcaattctgttccccgaggaaacgtgcgttttagaacaaaagtaccagcccgctctcgctaggactaagtgagcttctcccttcttgtttgtagaggaaatccgaaaaactgcctggtttgccacctcaccctacctcccccacgagcgaaggagtgcgtgcggctttactcccagcccgactggtccactcccagaaaagcctcggtgggactccgacgtctagggagttgtagccgctaccagaaatatcgatgagcctttaccctgaggtttagaaaggcagctctttctggggcaaatacaaagagcgtgtttcttcctacaaattagtggcatcctcccgctgtatggattcagctggcaaagtaactcaagccttgtcctgactgcaagggtgggcggggtggacggctcggtgttctgcccgttgtgtcttacgctccaggtgctggtctacgcgggcctggacagtcaggggtaggagcgggagccgagaggaggcggaggagatggcgtcccagccgccacctccccccaaaccctgggagacccgccgaattccgggagccggaccgggaccaggaccgggccccactttccaaatggcttctctatctttaaagcgtagactttggtctgtagcagttgagagcggcatttgtccagccacggcatcgacagggagcaaagtctctccttaaaggtgttaacctctcgagaagttgctgaaagccggaaaggttttacgcaacaggaactcaagccccgtacactttgcattcttttccagcataactcagccagtgtttcggatcgagattggagaagcaactttaaagcaggagttctagatctgaggcctatggatggactttgtgtgcaaaatagtgtatttttctgaggcctgtattttttttttgtttggtttttaatcagtatcagttggtttctaggactttaaaaaggctaaaacatgcagagttgggagtgtttcgtggcctcgtgtggcttttgtttggtagtgctggacatcttaattcagataggtgtgattcaaatgtcaaatcacctactattgtaggttttcctaagcgtaaaaaccccaacatattggaatgtatttctgctgtattctgaaatcttttatttaaacactaaaatgctttaacacagtaacgacttagtttaataaggatatatacataacaagtaataagtttgattaggctggtaagccacggtgacattatctgctaccttttttttgagtgggttcttttttccccatttaggctgcttgtcgaatgagagaggttttattttttgcatctgttaaagttctttttatgtaaaattaaccattttcccactttatcgtgaaatattttaaacacagagaccagtagagagtaagataatacctatatattcactactcaactttaaacagtgttaacatttgccagacttatgtcgaatttttcaaaataaaagacggctaaactct

SEQ ID NO: 164510 - DNA, 1014 bp, Homo sapiens
  Payload ID: 12411
  Gene Symbol: PEX13
  Gene Name: peroxisomal biogenesis factor 13
  ENST ID: ENST00000414712
  CDS Start-End: 31-195
aggagcgggagccgagaggaggcggaggagatggcgtcccagccgccacctccccccaaaccctgggagacccgccgaattccgggagccggaccgggaccaggaccgggccccactttccaactttggtctgtagcagttgagagcggcatttgtccagccacggcatcgacagggagcaaagtctctccttaaaggtgttaacctctcgagaagttgctgaaagccggaaaggttttacgcaacaggaactcaagccccgtacactttgcattcttttccagcataactcagccagtgtttcggatcgagattggagaagcaactttaaagcaggagttctagatctgaggcctatggatggactttgtgtgcaaaatagtgtatttttctgaggcctgtattttttttttgtttggtttttaatcagtatcagttggtttctaggactttaaaaaggctaaaacatgcagagttgggagtgtttcgtggcctcgtgtggcttttgtttggtagtgctggacatcttaattcagataggtgtgattcaaatgtcaaatcacctactattgtaggttttcctaagcgtaaaaaccccaacatattggaatgtatttctgctgtattctgaaatcttttatttaaacactaaaatgctttaacacagtaacgacttagtttaataaggatatatacataacaagtaataagtttgattaggctggtaagccacggtgacattatctgctaccttttttttgagtgggttcttttttccccatttaggctgcttgtcgaatgagagaggttttattttttgcatctgttaaagttctttttatgtaaaattaaccattttcccactttatcgtgaaatattttaaacacagagaccagtagagagtaagataatacctatatattcactactcaactttaaacagtgttaacatttgccagacttatgtcgaatttttcaaaataaaagacggctaaactctcccattcttcttt

SEQ ID NO: 164511 - DNA, 1985 bp, Homo sapiens
  Payload ID: 12412
  Gene Symbol: PEX14
  Gene Name: peroxisomal biogenesis factor 14
  Uniprot ID: O75381
  ENST ID: ENST00000356607
  CDS Start-End: 81-1214
agtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 164512 - DNA, 637 bp, Homo sapiens
  Payload ID: 12412
  Gene Symbol: PEX14
  Gene Name: peroxisomal biogenesis factor 14
  ENST ID: ENST00000491661
  CDS Start-End: 1-483
caggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacaggtaaagattaatgactccatcaagtcacccctcacagccttctccaagcagccccttctctgcccctcccctctccctctgtctccactctatgtggtgacttcatttatctgctctgagaatctgttcacatttgcaaatgaagccgccgtcatttcggtttaa

SEQ ID NO: 164513 - DNA, 1479 bp, Homo sapiens
  Payload ID: 12413
  Gene Symbol: PEX16
  Gene Name: peroxisomal biogenesis factor 16
  Uniprot ID: Q9Y5Y5
  ENST ID: ENST00000241041
  CDS Start-End: 19-1059
gtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctatgaccgcttctccgaggccaggatcctcttcctgctccagttgctggccgaccacgtccctggcgttggcctggtcacaacgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgctcgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctccctta

SEQ ID NO: 164514 - DNA, 1335 bp, Homo sapiens
  Payload ID: 12413
  Gene Symbol: PEX16
  Gene Name: peroxisomal biogenesis factor 16
  Uniprot ID: Q9Y5Y5
  ENST ID: ENST00000378750
  CDS Start-End: 245-1255
acttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctatgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtc

SEQ ID NO: 164515 - DNA, 588 bp, Homo sapiens
  Payload ID: 12413
  Gene Symbol: PEX16
  Gene Name: peroxisomal biogenesis factor 16
  ENST ID: ENST00000525229
  CDS Start-End: 18-176
tcggtgccgagggcaggatggagaagctgcggctcctgggcctccgctaccaggagtacgtgactcgtcacccggccgccacggcccagctggagacagcagtgcggggcttcagttacctgctggcaggtgccaccctgacctttgatcagttccttctgggccctgacctatgaccccagtggcccccttccctgcggagtcagggtagtgatcgctgtgcttgagaagacccgtccaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactggacagagagacccaggcacagcccccg

SEQ ID NO: 164516 - DNA, 903 bp, Homo sapiens
  Payload ID: 12413
  Gene Symbol: PEX16
  Gene Name: peroxisomal biogenesis factor 16
  ENST ID: ENST00000525192
  CDS Start-End: 422-903
agttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccag

SEQ ID NO: 164517 - DNA, 794 bp, Homo sapiens
  Payload ID: 12413
  Gene Symbol: PEX16
  Gene Name: peroxisomal biogenesis factor 16
  ENST ID: ENST00000529030
  CDS Start-End: 268-450
ggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctgggaagaagctcagtgaggttagagaacagtcactgatggtcccagaaccaagattcaagtctagatctcccagattccaggattcccagattgtaactacctcaagagtgtttgcccagtgactgctgtcacagtcctgaaagaatgcactgggttttgaaaagcagagtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaa

SEQ ID NO: 164518 - DNA, 563 bp, Homo sapiens
  Payload ID: 12413
  Gene Symbol: PEX16
  Gene Name: peroxisomal biogenesis factor 16
  ENST ID: ENST00000533151
  CDS Start-End: 15-563
gtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgc

SEQ ID NO: 164519 - DNA, 795 bp, Homo sapiens
  Payload ID: 12413
  Gene Symbol: PEX16
  Gene Name: peroxisomal biogenesis factor 16
  ENST ID: ENST00000528674
  CDS Start-End: 270-464
ggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtcgattcgccgattcgcacgagctgtcagagctgggaagaagctcagtgaggttagagaacagtcactgatggtcccagaaccaagattcaagtctagatctcccagattccaggattcccagattgtaactacctcaagagtgtttgcccagtgactgctgtcacagtcctgaaagaatgcactgggttttgaaaagcagagtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactg

SEQ ID NO: 164520 - DNA, 1639 bp, Homo sapiens
  Payload ID: 12413
  Gene Symbol: PEX16
  Gene Name: peroxisomal biogenesis factor 16
  ENST ID: ENST00000532681
  CDS Start-End: 865-1590
gatctcccggtgccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtctaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctatgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccct

SEQ ID NO: 164521 - DNA, 3661 bp, Homo sapiens
  Payload ID: 12414
  Gene Symbol: PEX19
  Gene Name: peroxisomal biogenesis factor 19
  Uniprot ID: P40855
  ENST ID: ENST00000368072
  CDS Start-End: 23-922
acggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataat

SEQ ID NO: 164522 - DNA, 796 bp, Homo sapiens
  Payload ID: 12414
  Gene Symbol: PEX19
  Gene Name: peroxisomal biogenesis factor 19
  ENST ID: ENST00000392220
  CDS Start-End: 92-796
ttatctgcagagatcaggccaaagggagctctagaaggttgttggggagcactaaactggagaataagagaagatagtttaatgccgtaccatggagtctggtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatg

SEQ ID NO: 164523 - DNA, 734 bp, Homo sapiens
  Payload ID: 12414
  Gene Symbol: PEX19
  Gene Name: peroxisomal biogenesis factor 19
  ENST ID: ENST00000495624
  CDS Start-End: 1-358
cgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatggtgagtatgtcttatttttccagattttaatttgagtccccaatttccagaattctttaacctctcaggattccacctaaggtgaaaattgtggctactggggatggatcttcacgtctgtcctaaaaaatgagcaactatctgagtcccttcatctcttccccagcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttt

SEQ ID NO: 164524 - DNA, 3504 bp, Homo sapiens
  Payload ID: 12414
  Gene Symbol: PEX19
  Gene Name: peroxisomal biogenesis factor 19
  ENST ID: ENST00000472750
  CDS Start-End: 31-153
cgcctcctacggcaagtcggaggtagcaagatggccgccgctgaggaaggctgtagtgtcggggccgaagcggacagggaattggaggagcttctggaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtga

SEQ ID NO: 164525 - DNA, 904 bp, Homo sapiens
  Payload ID: 12414
  Gene Symbol: PEX19
  Gene Name: peroxisomal biogenesis factor 19
  ENST ID: ENST00000462644
  CDS Start-End: 84-584
agagatcaggccaaagggagctctagaaggttgttggggagcactaaactggagaataagagaagatagtttaatgccgtaccatggagtctggtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtggaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattggg

SEQ ID NO: 164526 - DNA, 894 bp, Homo sapiens
  Payload ID: 12414
  Gene Symbol: PEX19
  Gene Name: peroxisomal biogenesis factor 19
  ENST ID: ENST00000532643
  CDS Start-End: 23-583
acggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtggaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcaga

SEQ ID NO: 164527 - DNA, 4317 bp, Homo sapiens
  Payload ID: 12415
  Gene Symbol: PEX2
  Gene Name: peroxisomal biogenesis factor 2
  Uniprot ID: P28328
  ENST ID: ENST00000357039
  CDS Start-End: 397-1314
tgtcggcgttcgcggttgtttggccatccagtgccttcagcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatatgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatctggtgatccacctgcgtcagcctcccaaagtgctgagattacagacgtgagccactgtgcttggccgcctcagttgtaatgttatgcttttctctgaagccaatttttaagaagttcagtcctcagctgtctgacccctccacagttggctttatattcagaaagtaaaaattacttaaggcagcttggaagtgaggcctgggaactactgggggcaactagtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatgatggaaatacactgccagttcatttttctcttcacctttcattgaacaagtactcaggtgccaggtactgatgtagccattagaggcacaacagtatattaagcaggaaaaatcaagttaccttcatggagtttacattctgtgattgaatgaactgtaagtttaatttaggttcaatttagtgtaagatactgaagaagttttgtagtttgagttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacatttcttatttacaaaattattataatgcataaaaaatagcattttttcctatgtataaatattcttcaaaactattttagggctgagcacaatggctcatgcctgtaatcccaggctccctacttagggaggctgagcccaggagtttgagttcgtttctaaaaaaataaaaatatatacaaacgtctttgttttttgtttgtttgtttgtttttggtgagaaagggcctcacccagtcacccaggttggagtgcagtggtgtgatcatggctaaccgcagcctttccctcccagggctcaagcgatcctcccatctgagcctcccaagttgctgggaccacaggcccataccaccatgcctggctaatttttgtagagatgaggtctcactttgttgcccaggctggtcttgaacttctgggctcaagcagtcctcctaccctggcctcccaaagttgtgggattacaggcatgagccactgcacccagccataatatatttttaaaatgctatgtatatgccatcatattcctattcctattattatttaaccaccatcatagagcatttaggttcttttcactttctgttgtgaataatgcaatgttgaatctgagttcattaagtgaagagtccagctgcacactgcaggcccagtctggatgtaggtgctcagatggttctctttgagacaggctttatcctttggctctcatttttttgatgagtgtacatggcatgagggacacagattccgctagaattcaaatcccacttgtgtataacctagggcaatgtgccacatctctgcacatctgttcattgtaaggattacatgtttagtgtatataaagctcttaaaacaatgcctgacacatagtaaatagaatataatagtagtgctttcctttgctgttgtcagtattactctgagtcggtttcattctcacacagaatgatggccgctagaagctcaaggcttataatctgctagctttctgatcccactggcatgagatactcttgcctaatagttacagctaaagtccaggagctcactgttactggtctgccttggattatgtgcacattcctgaaccagccactatagctaggggatggaaaatactgttcctggttacttaaatgtaggtgatgctcctcccatataccacatgaacctaaaggagtcctggaggaggccgttcaccacaggaaactgaggtgttcttagaagggtggatgctggcagatctctactagttagagtctacatttgccttactcatttcaaaagtccacattgcagtctcattttaccagtgatctagcttgataaggacattcataagtaactggatgattctttaacattgcagatttgaaaggattaaataaagtcaacaaaattgttatatcaa

SEQ ID NO: 164528 - DNA, 1470 bp, Homo sapiens
  Payload ID: 12415
  Gene Symbol: PEX2
  Gene Name: peroxisomal biogenesis factor 2
  Uniprot ID: P28328
  ENST ID: ENST00000520103
  CDS Start-End: 226-1143
actgccattcataccacagaacgagaaggcagtggcgatcctcaacggctacatgtcactgcctgccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatatgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagatt

SEQ ID NO: 164529 - DNA, 1627 bp, Homo sapiens
  Payload ID: 12415
  Gene Symbol: PEX2
  Gene Name: peroxisomal biogenesis factor 2
  Uniprot ID: P28328
  ENST ID: ENST00000522527
  CDS Start-End: 406-1323
gggtgtccgcttcggcttttcggcccttcggctcttcggcttgtcggcgttcgcggttgtttggccatccagtgccttcagcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatatgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaag

SEQ ID NO: 164530 - DNA, 700 bp, Homo sapiens
  Payload ID: 12415
  Gene Symbol: PEX2
  Gene Name: peroxisomal biogenesis factor 2
  ENST ID: ENST00000518986
  CDS Start-End: 162-700
ggcagtgtggagaatgcactgaaggaggcagaagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcc

SEQ ID NO: 164531 - DNA, 473 bp, Homo sapiens
  Payload ID: 12415
  Gene Symbol: PEX2
  Gene Name: peroxisomal biogenesis factor 2
  ENST ID: ENST00000519956
  CDS Start-End: 465-473
ggaggtaagaactaagacgttcttaaaccctactacgtgctggaatcctgaagtgcctgccatcattcaaacttaagcactaactctctagagagacactgccattcataccacagaacgagaaggcagtggcgatcctcaacggctacatgtcactgcctgccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttcc

SEQ ID NO: 164532 - DNA, 18445 bp, Homo sapiens
  Payload ID: 12416
  Gene Symbol: PEX26
  Gene Name: peroxisomal biogenesis factor 26
  Uniprot ID: Q7Z412
  ENST ID: ENST00000329627
  CDS Start-End: 207-1124
acagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcggctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcaggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagtcttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcagtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttagccgggatggtctcgatctcctgaacttgtgatccacccacctaggcctcccaaagtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtaaagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatatgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaaaccccatctctactaaaaatacaaaaaaaaaatgagccgggcatggtggtgggtacctgtaatcccagctactcaggaggctgaggcaggagaatcacttgaacccgggaggcaagggttgcagtgagctgagatcgcgccattgcactcccacctgggcaacaaagagtgaaacttggtctcagaaacgaaacaaaacacaaaaacctttctcagtcccagcatatgtggagcagcctcattcttcatagctgtgtgtcattccgttgcgtgatggggtcacagagcacagacctggtgcccttttcctttttaatatgtggaaacccctccatgctttccaaagcctacaagtacagcagccccaagtttagggtgagcagcagtggtcagagctctttactattacttttgggcaaacgcaagccaggctggcaaccaccactgccgccgaggggagatacaagcaggccagttcacactctggacgttcagtttctttctacatctagaaggtggcctctgctatccacttaaagcagcccaaggaactgtcagaaagcgaaagtgatgacatgaaccgcgagtagggcacctccctgtgccgtcgtctgctttccttcctccctcccagcctccctgtgccgtcctctgctttcctccctcccagcacggaaaagccgtggggccgatggactttggcctcacatccacagatggggcctgtgggaattctactgatttactctctggcctagtcaagcaacccacccacggcctggccaaggtcggcctcaccgccctggcctagcacctttggaaactgaatacatggagtgttaaccagaaaaatgtctggcccttttgcctcgctgcctctggaaacctcagtgtttcgggctggtaggaagctacaggacagacagtgggcacggtgcctagcagcctgtcgcgcccccgcccgcctctgcattcctccagcggtggtgtacggatccagacattgtttgccacctctaggcctcttgataaaacagcaagtatttttcttgtcttaaagcaatgcatgtatattttagaaaatattaattgcatagaaggaaatacaggactcgtgatcccaccactcagaaataattactattaatacggttgattttctttcagcttttttccccctaattaattaactaattcttttttttcctgcaactcctgcttcacagactttttttttttttttaacttggcatggtggctcacacctataatcccagcactttgggaggccagagtgggaggattgcttgagcctaggagttcaaagctagcctgggcaacctagtgggaccccatttcttttttttggggggggggtgggttataaaagcccttttataaagccaattttaaacaagaaaaaaacaaaaagtttacaaaagaaaaaaagatacagaaaaagaataacttgcttcatatgtcccaaaaagagaaaaaaataaacgggacaatgccaacatgctcaacaataaagggttctttttcttacttttttaatacaaaatacaagcaaaggatacacatacttaaaacagagctcaggagcagacacgcagtcctgggaacccttcaataagagcaaagcaggagtttgttttttctttgtgcagatacatacagagactgggatatgtaaaaattaagtatcacaaaagaccatcacacgattctaccaatgcatgttgcatctataattcacgaacatggtcaacaagatcatgttcacttcaaccccatttcatttaaattaaagaaaaaaacctggccgggcgcggtggctcacgcctgtaatcccagcaccttgggaagccgaggcaggtggatcacgaggtcaggagatcgagaccatcctggctaacacggtgaaatcccatctctactaaaaaaatacaaaaaattagccgggcgtggtggcgggtgcctgtagccccagctactcgggaggctgaggcagaagaatggcgtgaacccaggaggcggagcttgcagtgagcctagatggcgccactgcactccagcctgggggacagagcaagactccgtcttaaaaaaaaaaaaaacaaaaataaaccttttaaataaagtggttacattctaactttaacttccttagtaccatgctgcaggtttcagcactgttaaggtattgcaagaatgcccaaccctctggtgtctgattgtgtatctagcaacattgcagtatgaagaaaagagatgccccgggtacgaccccatttctattaaaaataaatgtaaacacccaaccctcttggcagcccatgcacttgagaacctgtagaaaatggcagtgtgcaaccagcatggctgcgagctcagcgtcttcactagagagagtggaggtggttaggaaagggcaggcgggaaggggccatgttggccggacaactgcaggtgaagatgggattgtgaagtacagtccaaggcccactcaccaagggctggatccaaatatgtggggttgggattctgtgacctacttccaattttaatattgacctgagctcatatttagctctacatgtttcccagctcgtattttccaacagcccctttaaaacttttagcatcctcttgtcacttttgtactatccaaggtgggacggacaggtgtcagataatagcagagacttggtgaagaaatgaaagcacttttgtagaagagtgtcatttcagaaaaaagccttttttttttgagatggagtctcgctctgtcacccaggctggaatgcagtggcgtgatctcagctcactgcaagctccgcctcctgggttcacaccattctcctgcctcagcctcccgagtggctgggactataggcgcccgccaccacgcctggctaattttttggtatttttagtagagactgggtttcaccgtgttagccaggatggtctcgatctcctgacctcgtgatccgcctcccacagtgctgggattacaggcgtgagccacggcacctggagagaaaaaagcttctttaatgacgacctcaacataatttacatggagaagtttcttaggtggaaaaccgatttgtatggtcctcagaatgtaacctacaggttcttgccctcagaaaaatgcatgcatacttttatgttacaggcttattttccaaatgcggtagagggccatcccttctttggcttcttgccttgtctctgaccccactgactgccccttttctgcctccatagctagtttcttattttcctttggctttttttttcttttcttttcttttcttctttttttttttgagatggaatcttgctcttgtcacctaggctggagtgcagtggtgcgatctcggctcactgcaccctcctcttgggttcaagccagcgaggtagatattatcattttagagacagcaaaacagactcagaggggctaatgtgcccagtgccccaccgcttttaaatggtagagctgggatttgaatctaggcatacaggtaccaggatttctgttcttatctcccccatagcacctggaatgaggccatccatgtaagaggccaagtaataaagatttgttgaatgaacttggattttggccttaggaattagggaaggaagaaatagaagcagcaagagttggtgagcaataagacccgcaccagggctgaagggtggaggtggggcaggggagggctctgtgctttggcatctgtttagtagtatcgtcgcccagctccctccagagaaagagcaggaggtgttcttctcagatgtaccagcaatgacaaagcctggcgggtgtcctcctgggtaggtataaatacaagctggtagtttcattggatgactcacacagataagccatgctcttggttaccagtggacttagctgggtctcaaagaatgggctgctttctctggaaagctggggagctggtaaaattttttggtcgccccaccagagacatcctacccattcccagtccctctgtgggctctgacatctctgtccggcgggcaccccctgctctggaacattctgggaatgcttcccactccccttttagtacttgtttgtgttctgtcctgttcctggatttcatggtctccatggtgacaagtgcttgttttcagaggtgctaaagacaatggctaaaagatgtgctctattaatcctcccaggaaacatattttgcaaaagcctttttttttttttttttgagaaacaaggcctaaccccaatggagtaatttgctgcgtaaatgagagacatcatgggattgtggttaagagtgtgggtcccagacccataatgcccaagtttgtatcttttttttttgagacagagtctcactctgtcgtccaagctggagggcagtggcatgatctcgacacactgcaacatccacttcctaggttcaagcgattctcttgcctcagccttccgagtagctggaactacaggcacacactaccacgcctggctaatttttgaatttttagtagagacggggttttaccatgttggccaggctggtcttgaactcttgacctcaagtgatctgcatgcctcacctcccaaagtgttgggaatacaggcatgagccaccacacccggcctgagtttgtatcttgactcacctgctttgaccttcaaataatctttcctgtgcctcagttacttcataggtttgttgtgaggattaactggtgctaatccatgtaaaacactgaaaaggtgcatagcatgtagtgagcaggtgctagttattattactgttgctcttaattaagtgaggtaaggaggggagagttggagtggtagaacccagcatcttgtgaacatcagaccacagaaaaggcagcacttctgattcctgttcttagcctaggaactaggctttgcaaatggctctgaattttttttttttttttgagatggagtctcgctctgtcgcccaggctggagtgcagtggcacgatctcagctcactgcaagctctgcctcccaggttcatgccattcttctgcctcagcctcccgaatagctgggactacaggcgcccgccaccacacccggctaattttttgtatttttagtagagatggggtttcaccgtgttagccaggatggtctcgatctcctgaccttgtgatctgcccacctcggcctcccaaagtgctgggattacaggcgtgagccaccacgcccggccggctctgatttcttaaagtgctaagcctttttatatattcatttcagaccatgtttaattttctaaatatgcaatacattcatagggtttttgaaaaggcttgaaaaagtctagtgtgaaagcagtctgtattagtccattttcacactgctttagagaagtatcagagactgggtaattgttgaagaaaagaggtttaactgactcacagttctgcatggctgtgaggcctcaggaaacaagcagtcatagtggaaggcaaaggggaagcaaggcacatcttacatggcagcagcagagagaatgaggggggatgccacactttaaaaccatcagaactcgtgagaactgactcactatcacaagaacaacaggggagaaactgttcctgtgatccagtcacctcccaccaggtccctcctccgacgtggggattacagtttgagatgagatttgagtggggacacagagccaaaccatatcacctcccatctcttcatttagcaagttcacctaccccaatggcagctatggccgttagttttttttttttttcttttttttgagacagagcctcactctgtcgcccaggctggagtgcaggggtgtgatctcggctcactgcaagctccgccttccgggttcacgccattctcctgcctcagcctcccaagtggctgggactacaggctcctgccaccgcgcccggctaattttttgtatttttagtagagacggggtctcaccgtgttagccaggatggtcttgatctcctgacctcgtgatccacttgcctcggtctcccaaagtgctgggattacaggcatgagccaccgtgcctggccacagccattagttttaaatttactcttccagaggtaaatttaatacaccaatacaaaaccagtatggatatagatcctagtttcttctcctttttataaaaaaaacctgtagtatattatgtactctgttttattccttcctttttttttcttataaaaaatacagagatggggtcttactacactgaccaggctggtgttgaacttgcctcaagtgatcctcccatcttgacctcccaaagtgctgggattataggcataagccaccacacccagatgatttttttatttttcaaagaagtggcatgattttgatgacaataaaggacaatatgtaattaatggtaattataatacagccttctagaggccaggtgcagtggcccatgcccgtaatcccaccactttgggtggccaaggcaggtggatcatgaggccaggagtttgagaccagcctggccaacatgatgaaaccccatctcttcaaaaaatctaaaaattagctgggtgtggtggcgtgcacctgtaatctcagctacttgggaggctgaggcacaagaatcacttgaacccaggaggcggaggttgcagtgggccgagatcgagccactgcactccagcctgggcaacagagcgagactctgtctcacacatacacacacaaaaaaagtataaatatatagctttctagatataggattggactggttttggttctggctctgttactaatttgccctataactttgcataagtcatttaatctcgggtccaatttttctcacctccaagatggggacaaaaattatcttccttggctgggtgcggtggctcatgcctgcaatcccagcacttcgggaggccaagaccagcctggccaacatgatgaaaccccacctctactaaaaatacaaaaattagctgggtgtgatggtgcacacctttaatcccagctactcaggaggaggctgaggcaggagaatctctggaacctgggaggcagaggttgcagtgagctgagatcctgccactgcactccagtctgggcgacagagtgagattctgtctcaaaaaaaagaaaaaagaaaaaaaaattacctccctcattttctttataatattattgtgtaaaatgagtaaaagtctataagaaaaactttgaaaagtattaagtaatacacatgtgtatgtgtgcgtgtgtagacatatatatataatatatatacacatatgcaatggagtaatgaaaatactatataataaatataaaatggattaaaactatataaaatagatgcatgaaatggctacatagatatggatgtttgcatataggcacatttagctggattaagttagatttaaatggtccaatagagaactgtgcatacaattacataggcaaccacaaatcaaccctttctctgggctatctaaaataatcaggtactagaccaaaaaatgacatgctgtctgccttaccttttagtgatgatttgtaggaagaggaaggtaggggctggtgagtggaaaagtagtagagtttgtgagggaatgttctgtatgtctgaagacaaagtctggagattggtgggccagaaggtgtgaatctactctgaaggacaggcaagagtccagcccagggaaaaaggtgcagatgggtaggatttgggtgggtacttgaattaaaaaaatgaatttgtgaggcaatattgctggagtcaaaaccaaaaaatcaaattgaccagggcaaaaaatagcctggggcctagcatggctctgctgccacgtaggatgactggacctctttccaggttcgtgttaacagtccatactacttatggtatacgtgaaatgctttctattcattcaagcaaccttactaaaaacaccccatgaaaataaaagtctatatcttcccttcaatatacattcatatgtgcttattttaagcatatatctaccaatttgagtttggcattctttttcatttaatattattacctattcagcttccaacattatcacttccttactacacacatttgtttcctaggactgctgttaacaaattgccacaaatgtatggcttaaaacaacagaaatttattatctcacagctctgaaggccagaagtcagccaaagcctctgcctctgaaggctgtaggcaagattccttccttgtttcttccagcttctgctggctctaagtgttccctggcctgcgacagcatcactccaatccctgcctcagtcttcgcttgaccttcttcgtacctctgtatcttctctgccaaggatgcatgtcactgaatttaagagccaccctaatccaggatgatctcatcttgaggtcctcaattacatcaagatccttattccaaataatgtcacattctgagattttaggcaaacatatctttggggggccaaaattcaatcccctaatccatgttagtaaccatgcagtgttccttcttatttctatgttgaccttttcagctctttctatttattgttattatttttgagatagagtttcaatcttgttgcccaggctggagtgcaatggtgcaatcttggctcacggcaacctccgcctcccaggttcaagcaattctcctgcctcagcctcctgagtagctggtatgacaggcatgcaccaccatgcccagctaattttatatttttagtagaggcagggtttcgctgtgttggccagactggtctcaaactcctgatcttgggtgatctgccctcctcagcctcccaaagtgctgggattagaggcgtgagccaccatgcctggccagctctttctaactaaaaaataataataataataataaaaaataaaagatgatacttgcaaaatacctcaagtgtacctcatttacctcaaatatacctcatggtccgaaagtatttagtcagcaatgtaccattatagaaaaacacatagcttgtggctccaactttaaaaccagaataaccaagtgaaaagtcagtacagattctcacttctacttaaaaaatcaaaggtacacattgggaattgaacagctatgttttttcttctttctagagatgtgacatacatattttctggtcagtaatattctaccaatggtattaattcaaagcaggtagatgaccagcgatgctgtttactacatcctacgcatgctgagatagatgagtgggacaccatctcggtaggaaagagtttgacaggaagaagaaattgcagagtccctgcctgtcccagagaacctaacaaactgatctatatggaaaggattttcagcaaacatgcacaaacacagttaatatgctggaagaagaggatagcttttagtctatttccagcacacggcctacactcactggtaccccatacaacaggaatgaatgccgacttagcatttttgccttcacagcgctggcaactaaaaggctcacagatactctgatctttaagcagataatcatggaattctcaacatcatatccactaggttaggctgagggttcatctataaaagtatttttccaaaaataatgcttaaaagagacttctagaaacagtgggactgtatcaggatcaacagaagacttcttgacccaaagattcaaatatagaactaggaattgattttcacatgtagtttttaggtaaaggacatctctttcagttgattcctacagccaagactagctttgatcctgggagattcagaaacctcaagatgggtagctggcttgagtaacatcctagataatagtcccagtcaaaaaccccattgaggttgaaggactggaaactgacctgtgtgaaaaagagctatcagtgcaggaaaagactcatgctgattttgaccttcctctgacccttttccctcaactgcttggtggggagtagcgaggagaaggagcatgtggcaccctcattggaggctggagcactgctgcagaaagtgatctcttactcatacttcaagacacagcctaagtatgaccacctgtatggacccttccctaatgcccaggatcaagaaaagaatgtggccaccttccaaggctcagagtagctgtgcaatgacttgtgtcaaaacccgatccagagcagcagtgatgaaatcaccctctcctttaagacctggcattacaatggcctcatcctgcatgtgggcaagtcagctctctgatggatggtgcaatttccttggtcattaacctgaggtctggggcctttaaagctattgaggagccagtgaatggagaattcgacaacgcctggcatgattgagggtgacacatcacggcagatgatggctgaggagacattgcccagaagtctcatcttaggtggttgagtaggaagtttgtgaagcaggtggtgggtgagatggagtgggtagagattcaggtatggagatgtcagtgtctaactttcttctagtctttgcaatttcacaaggaaaatcactaaaatgtgcgtctcttcatttaaaagaaaaaaaagttcatgccaaagctgctgggacaaagaggactcatgatagtgggttattccacactgttgacacactgaatgtatgctggcagaagggcctcaggtggaatgctgggcatgggtttgccccacagcagtctgattcaaaagcacctgagagatgggaggagtactagggttactaaacacaagaaggtgtttcaggagaaacacatcaagccatttgtttttgacccttaatacttaacatgaatgatgagttgcagaacagtcagtctttccaagatgtattgttctatcctcaatagctgcagcctctccaagccagtgggctggtgacatccaggatgatcctcttccttgcctggaggtgggatctagtgccacagcttgttcggggaagctggcatagaagatgatttgctcaacaaagtcaccgctaaactatcgcttaggtctagtccccggcctatggcaccaagtactcctggtagtacttgtacacagaatttctctataataaccagaacatgtcatccatggtaatgtctgctacatatccaaccacagcatcaaattctgtctgatgaagggcaccagccccttcatctttatcatgcctaatattgtgaaggccatgtgctaaatccagcaatccgctccagtaggtgtccttcaggatacttttctgtcaagtaaatacatttattaaaaataggcatgtagccgggcgcagtggctcacacctgtaatcgcagtactttaggaggctgaggcgggcgaatcacgaggtcaggagttcgagaccagcctggccaacacggtgaaaccccatctctactaaaaatacaaaaaattagctgggcatggtggcgtgtgcctgtaatcccagatactcaggaggctgaggcaggagaattgcttgaacccaggaggcagaggtggcagtgagccgagatcgtgcgatcgtgctattgcactccagcctgggcgacagtgtgcgactgcatctcaaaaaaaaaaaaaaaaaaaaggcatgtaaaagttaatctcatggaggtagagagtagaatgacaattactagaggctgggcagggtgtgtatgtgggatgaagaggtggcttgatggacacaaacatagatagaaggagtgagttctaatgcttgatagcagaatagggtgaccattgttaacactgtattgggtgtttcaaaatagacggaataaaggatttgaaatgttctcaacacatagaaatgagaaatactcaaggtcatgggtatcctggataccctgagttgatcactacacattctatgcatgtaatgaaatgtcacatctacttcaataatatgtacaaatattatttatcaaaaagcaggcatgtaggtgagttgattttcttccatgtcttcaaactcctggtaatacttgtccacaaaatttctctataataaccggaacatgtcatccatgataatgtgtactatatatccaaccacaacatcaaattctgtatcagaggcagaagagaaggacagcatgaagctcgattcctccaactgtcctttggctggtggccctccaccctgcccacagcccggccagctcagccccgtctctgtcccatacagagccacagccacagtgagagcctggcagcctgcccggaggaggcttcttggcccagcccggtcaacacccacatgcaccaccaccaactttttgctattgtgaataacatagctgtaaacagattgcatatgaaagtgctgtgaaatcaccaagggctgagtagaacagttaagacgatagtagttgttttctttctgggtttttctcttgggctggtttttgaaagtggatctacaacattgatagagatcagtttttctgctcttccaacatactgccaggacgtggtccagaaagattgggtactttgcaatactcatagcaatatgtgaagtgattggaaaaaatgagactattcaaccagttgtttcagtgttggttaggaggaaaatgcccagaaaggggaacagttaatcatctacacaataccaagagcaggaggggatgaccgacggcttcatctttcctagtctatcccacacagacctttaggtgctcttttttttctttttttcgctctgtcgcccatgctggagtgcaatggcgcgatctcggctcaccacaacttccacctcccaggttcaagcgattctcctgccttagcctcctgagtagctgggattacaggcatgcaccaccacgcctggctaatttttgtatttttagtagagacggggtttctccatgttggtctggctggtctcgaactcccaacctcaggtggtccacctgcctcagccttccaaagcgttgggattacaggcatgagccatcgcacccgcctctttaggtgttcttttaggagctggtagcggaggaaggtggttacccatctgtgacagagccttggatgtcacgaggccacaggctggcctttcctcctgtttacaggaggtgagttttcctgagttcccagcctcagtgttctctgcacagtctgtcactgactcccgctcccagtgctcactgcctcttgttctcactgcctcctgttctcactgcctcctgtttctgctgagttctttgcatctgcctgatgttggtttaaagctccacccctcccaggggaatttgtcccatgattcacctcctctttggtgatctcttgattgcggctgctgcagccatgtaaaccttaaaggcgagccaatttgtttgtgatccagtggccaaaatggttcaccctcaacttcccttaatcccctgcagcatctgagacacatgggtgaatgtatgtaaggtacttggggctaaccaaagttaaatacatatgacaagtacctgaatctagataatctaatggtaagatatcgtttgctctctggacttcatgggctcaccccagcaatggggtgcctggaaatgaagagatctttcttgtgtctcatcctctgggctcccagcctccctcaacatcatgacctccatctgtaacacccaccatcctggagcagcatcctggatattggaactctgaagtctaacctaagagaacaaggacaagcctctctatgaaaggtttgcccttccagatccagttgagctctgctctggagccagactctctgaagcatagcccagctctagctcttaccagttatgtgatcaggaatgagagttaatgtttctatgtttctgattcttcatttgtaaaatgaggataataaaaatttaacttca

SEQ ID NO: 164533 - DNA, 1672 bp, Homo sapiens
  Payload ID: 12416
  Gene Symbol: PEX26
  Gene Name: peroxisomal biogenesis factor 26
  Uniprot ID: Q7Z412
  ENST ID: ENST00000399744
  CDS Start-End: 370-1287
gcgagcgcaaagatgtccgcgcccgctgccgggaggcgaggtgagtctttgatcgtaaccaggagcccggagctgaggcagttcctgcacgtgtcgcggggccggagaagctagggccaggtattccagggatgcaagaatcctgcaaatctgacgtgtaaactgcttccccagcctccaggcgagcccagcttttgcctcagataggccccttccttttccttctcggggaatcgacctcgggaaggggtgtgggcaaagagatgaggactctccctcttcgcccaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcggctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtga

SEQ ID NO: 164534 - DNA, 815 bp, Homo sapiens
  Payload ID: 12416
  Gene Symbol: PEX26
  Gene Name: peroxisomal biogenesis factor 26
  Uniprot ID: Q7Z412
  ENST ID: ENST00000428061
  CDS Start-End: 1-771
atgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggc

SEQ ID NO: 164535 - DNA, 2082 bp, Homo sapiens
  Payload ID: 12416
  Gene Symbol: PEX26
  Gene Name: peroxisomal biogenesis factor 26
  ENST ID: ENST00000474897
  CDS Start-End: 363-932
caaagatgtccgcgcccgctgccgggaggcgaggtgagtctttgatcgtaaccaggagcccggagctgaggcagttcctgcacgtgtcgcggggccggagaagctagggccaggtattccagggatgcaagaatcctgcaaatctgacgtgtaaactgcttccccagcctccaggcgagcccagcttttgcctcagataggccccttccttttccttctcggggaatcgacctcgggaaggggtgtgggcaaagagatgaggactctccctcttcgcccaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaat

SEQ ID NO: 164536 - DNA, 3924 bp, Homo sapiens
  Payload ID: 12416
  Gene Symbol: PEX26
  Gene Name: peroxisomal biogenesis factor 26
  Uniprot ID: Q7Z412
  ENST ID: ENST00000610387
  CDS Start-End: 210-980
attacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcggctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcaggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagtcttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcagtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttagccgggatggtctcgatctcctgaacttgtgatccacccacctaggcctcccaaagtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtaaagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatatgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagtt

SEQ ID NO: 164537 - DNA, 1969 bp, Homo sapiens
  Payload ID: 12417
  Gene Symbol: PEX3
  Gene Name: peroxisomal biogenesis factor 3
  Uniprot ID: P56589
  ENST ID: ENST00000367591
  CDS Start-End: 64-1185
gaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatataaaaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaata

SEQ ID NO: 164538 - DNA, 784 bp, Homo sapiens
  Payload ID: 12417
  Gene Symbol: PEX3
  Gene Name: peroxisomal biogenesis factor 3
  ENST ID: ENST00000367592
  CDS Start-End: 237-784
tgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataa

SEQ ID NO: 164539 - DNA, 3252 bp, Homo sapiens
  Payload ID: 12418
  Gene Symbol: PEX5
  Gene Name: peroxisomal biogenesis factor 5
  Uniprot ID: P50542
  ENST ID: ENST00000266563
  CDS Start-End: 184-1992
cttaaggccccgccttttcagacagcttccgctgggcctgggccgctgcggggcggtcacggcccctttaagcctgagccccgccccctggctccccgccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatga

SEQ ID NO: 164540 - DNA, 3170 bp, Homo sapiens
  Payload ID: 12418
  Gene Symbol: PEX5
  Gene Name: peroxisomal biogenesis factor 5
  Uniprot ID: P50542
  ENST ID: ENST00000266564
  CDS Start-End: 18-1913
gagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggta

SEQ ID NO: 164541 - DNA, 1508 bp, Homo sapiens
  Payload ID: 12418
  Gene Symbol: PEX5
  Gene Name: peroxisomal biogenesis factor 5
  ENST ID: ENST00000396637
  CDS Start-End: 278-1508
gcgtgctggggctgcgcggggctaggtatggtcgggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagtgagtgttcttgaggtggaaagcccaggtgcagcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtga

SEQ ID NO: 164542 - DNA, 2105 bp, Homo sapiens
  Payload ID: 12418
  Gene Symbol: PEX5
  Gene Name: peroxisomal biogenesis factor 5
  ENST ID: ENST00000412720
  CDS Start-End: 90-2072
ggcagcagggccggggagatgggcggtggggagcgcgggagggaccgggccgagccgggggaagggctccggtgacttaaggggagggaatgctcctctgccgtgctcaccgcgtgctggggctgcgcggggctagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacct

SEQ ID NO: 164543 - DNA, 2689 bp, Homo sapiens
  Payload ID: 12418
  Gene Symbol: PEX5
  Gene Name: peroxisomal biogenesis factor 5
  Uniprot ID: P50542
  ENST ID: ENST00000455147
  CDS Start-End: 581-2500
gacgctaccccgctaggggttatttggaagcggggcaggcctaggaggctgaagaaggcttcggactggactccccagcccctggtgttagggcttttctctttcttgggcttgggaacattagccagccccattttagaggggaaaactgaggctcagaaagggcactgaatccccttaggtcacaatgcgcccaagggaagaggcaggatcgactgagcctaggatctcgcgtcttcggctttcccccagagcctgggaagcccttcttagctccactcttctttgagctttccgtcaaacaaatcctagggcccgtggccttttcgagcgctcctaaaggcgactctccaagacccgctctctaagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctaaatatacagcctctgcagacactgcttctgaatgaacgggctggagtttccttgggatcctgaactcatattggattctctacctaccatcttggacaattcatgtaggaaaacaaatcctcatttgttcaaacaatagatgaaaattattaaagttttgacacatatt

SEQ ID NO: 164544 - DNA, 2253 bp, Homo sapiens
  Payload ID: 12418
  Gene Symbol: PEX5
  Gene Name: peroxisomal biogenesis factor 5
  Uniprot ID: P50542
  ENST ID: ENST00000434354
  CDS Start-End: 81-2045
tcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagtgagtgttcttgaggtggaaagcccaggtgcagcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcc

SEQ ID NO: 164545 - DNA, 2477 bp, Homo sapiens
  Payload ID: 12418
  Gene Symbol: PEX5
  Gene Name: peroxisomal biogenesis factor 5
  Uniprot ID: P50542
  ENST ID: ENST00000420616
  CDS Start-End: 519-2438
ggtgccccggcgggtcgtgcggcgcggcgctccgcggtgagcgcctgaccccgagggggcccggggccgcgtccctgggccctccccacccttgcggtggcctcgcgggtcccaggggcggggctggagcggcagcagggccggggagatgggcggtggggagcgcgggagggaccgggccgagccgggggaagggctccggtgacttaaggggagggaatgctcctctgccgtgctcaccgcgtgctggggctgcgcggggctaggtatggtcgggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggaggg

SEQ ID NO: 164546 - DNA, 522 bp, Homo sapiens
  Payload ID: 12418
  Gene Symbol: PEX5
  Gene Name: peroxisomal biogenesis factor 5
  ENST ID: ENST00000537873
  CDS Start-End: 18-522
gagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagttcttacccgttccaggtatgatgaatatcatcctgaggaggatctgcagcacacgg

SEQ ID NO: 164547 - DNA, 641 bp, Homo sapiens
  Payload ID: 12418
  Gene Symbol: PEX5
  Gene Name: peroxisomal biogenesis factor 5
  ENST ID: ENST00000540398
  CDS Start-End: 336-641
gaagaaggcttcggactggactccccagcccctggtgttagggcttttctctttcttgggcttgggaacattagccagccccattttagaggggaaaactgaggctcagaaagggcactgaatccccttaggtcacaatgcgcccaagggaagaggcaggatcgactgagcctaggatctcgcgtcttcggctttcccccagagcctgggaagcccttcttagctccactcttctttgagctttccgtcaaacaaatcctagggcccgtggccttttcgagcgctcctaaaggcgactctccaagacccgctctctaagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggct

SEQ ID NO: 164548 - DNA, 548 bp, Homo sapiens
  Payload ID: 12418
  Gene Symbol: PEX5
  Gene Name: peroxisomal biogenesis factor 5
  ENST ID: ENST00000543974
  CDS Start-End: 193-548
tccgctgggcctgggccgctgcggggcggtcacggcccctttaagcctgagcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgt

SEQ ID NO: 164549 - DNA, 848 bp, Homo sapiens
  Payload ID: 12418
  Gene Symbol: PEX5
  Gene Name: peroxisomal biogenesis factor 5
  ENST ID: ENST00000542539
  CDS Start-End: 104-848
attattgcccttggtcatttaccggcagccctgggcccctccttgctcttctccatgacactaggactcccttggtcttgaagctggagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatac

SEQ ID NO: 164550 - DNA, 562 bp, Homo sapiens
  Payload ID: 12418
  Gene Symbol: PEX5
  Gene Name: peroxisomal biogenesis factor 5
  ENST ID: ENST00000545845
  CDS Start-End: 179-562
cagatgcctatgggcttcatcaacccctgattttagaggaactgcgtcattgtacatctctgtctttctctcttaggcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggct

SEQ ID NO: 164551 - DNA, 579 bp, Homo sapiens
  Payload ID: 12418
  Gene Symbol: PEX5
  Gene Name: peroxisomal biogenesis factor 5
  ENST ID: ENST00000544456
  CDS Start-End: 266-579
tcccccaagccagcacctggtgccccggcgggtcgtgcggcgcggcgctccgcgtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagag

SEQ ID NO: 164552 - DNA, 575 bp, Homo sapiens
  Payload ID: 12418
  Gene Symbol: PEX5
  Gene Name: peroxisomal biogenesis factor 5
  ENST ID: ENST00000536883
  CDS Start-End: 229-575
atgcaccctgggctgggatggtacttctgttcgtctggcattattgcccttggtcatttaccggcagccctgggcccctccttgctcttctccatgacactaggactcccttggtcttgaagctgggcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccag

SEQ ID NO: 164553 - DNA, 878 bp, Homo sapiens
  Payload ID: 12418
  Gene Symbol: PEX5
  Gene Name: peroxisomal biogenesis factor 5
  ENST ID: ENST00000545574
  CDS Start-End: 61-878
cagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcattggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataa

SEQ ID NO: 164554 - DNA, 386 bp, Homo sapiens
  Payload ID: 12418
  Gene Symbol: PEX5
  Gene Name: peroxisomal biogenesis factor 5
  ENST ID: ENST00000541850
  CDS Start-End: 1-94
ggcattgtctatgttaggccagagcgatgcctatggggcagccgacgcgcgggatctgtccaccctcctaactatgtttggcctgccccagtgacagtgggacgggctgccctaggagaaaattaaacacctgggggaggaaaacaggaagctgttgtggcacctgtcaccacctgggggatcacgaggcagctggtgtcttgggctctgcagaaatatacagcctctgcagacactgcttctgaatgaacgggctggagtttccttgggatcctgaactcatattggattctctacctaccatcttggacaattcatgtaggaaaacaaatcctcatttgttcaaacaatagatgaaaattattaaagttttgacacatattaaa

SEQ ID NO: 164555 - DNA, 567 bp, Homo sapiens
  Payload ID: 12418
  Gene Symbol: PEX5
  Gene Name: peroxisomal biogenesis factor 5
  ENST ID: ENST00000536841
  CDS Start-End: 226-567
aagcggtggcctttgaggggggcggcaggagagagtaccgacctccctcgaactcctggcagaggtgggggtcgcagcaaaagcactggggtggagggcggccagtgtggggcagacgcctgtgtgccttcctcagatacgggcagagttgtggatgtgagaagggtctggcttgggtacctcagttccaaacctcctgtgtccatcagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttg

SEQ ID NO: 164556 - DNA, 2818 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000263962
  CDS Start-End: 172-2046
cagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcaggtagtaggtgtaaccttgaagaaaaagtggcactgtcttcaaaaaagtgacctgaccctggctttgggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtg

SEQ ID NO: 164557 - DNA, 8540 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000392649
  CDS Start-End: 114-1670
aacattagaatatcttgtaataaataataagttaaagatctctcctgacacagtcattgttgatttcactgttatagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaacaaaaaagactccacagaattgggatcaaaacagtctaattggctggggaataagcttctactgaggagtaaatgtgcacacgtgcttatcaattgaatgcgaggtacaggaataaaatcctctcctctgttacatctgaagtccttgggttgtgagagggcctcaagttaacagaaaccacaagtccttgaggcttacatatgttataacctattctagtttataaagacaaaaagctgaggccactgtgaggagtgccaggttttgatagtcattgtcaaagttgacttgggccaggtggtagctccagctggtcagcagaaggcagaggcattcaggcactcatcatgggtagcagcgaccacccagtctcagaccgtgcttctctacagtctcagcagcaaagtaaagctcaacaatgctttcaagaatggtattgtaagaattgtagaattcgagaaacccagtctggtaaggactcttggggccagcctccaagccatggcagggcctgcttgaatatgcctgattaagcatcctttccttccctgctccttcctcctgccatctctgtaccttgaccagaaagtcggcatgaatagttcatggacaaaggattgaatagcctctgaacaaaggattcaaagcaaactttgtaagtgttctgtgatgccattctatactttgagcagcagctgaatctgcagcctggatttaaagcctgaaactagtataaatgtcaaataattaatttgttgctaaatggtggcaaattttgtggcccaagttttattttgctattggaacacaaactccaaggagctgttttagggaagactaaacaatcttccattcttaccattatttggcaatttgcagagcatttagtagtactttctctagtgtatgtagtatctgtcagatctaagatttttataggctgtcaagaagtccagaattacggcccaagaggaaaagagttgcatttttcaataatattttttataaaattaagttaaaaccattattaaaacatgagtgacaggccaggtgcggtggctcacgcctgtaatcctagcactttgggaggcagaggcgggcagaccacgaggtcaggagttcgagaccagcctgaccaacatggtgaaaccccgtctttattaagaatacaaaaattagccgggtgtagtggtatgcacctgtaataccagctactcaggaggctgaggcaggagaatcacttgaaccagggaggcggaggttgcagtgagccgagattgcaccgctgcactccagtctgggtgacagagcgagactccgtctcaaaaaaaacaaaaaagtgacagtttataggaatagagcaccaccaagaaatcagtagcaagactttagaacagtctttttgtataaatcatatacagtaaatgttttgtttcttagaagtgcatctactttattttttggcagaacaatttttggcatcttatcttcatggcatgaaattgtcatttaaattactctttccgtttgaaaggggagggtatccttatttcccttctgaggtactctgagaaggctttgagtttcctttttcatgtattaatgtataacagcctaacagctcctagaagagggtattcttactagaatggctacatacgggtgacttcagttacatacaggtgacttccagggactgacttcgcctgtagattggatgaaaataaagagaaagccagtgattattgctgagtttcaaaatataaccatttctagtaggctacttctacatgctgttgtaccttcctggtgaggaggagacagagggataggggagaggaggaggaataaaaatccctctcactgggccaatcatactgattcattccctttacttcctccaaaactcactccccatgactcctgaaaaatgggtagatctcgtccaccaggaaattttaatagaatactatgcaccgtgctttctcagtcaatctggattcctactagaacagaaaagtaaggaaacataactgggtaggaatgtccacttacgtttcacaaactcacttttagagtttcatgccactttcctcattcttctctttaagatactattatattgaacgtgggacccatgtctaaatacttgtatagataaatatttcttgtatattcttcccatacaagcaagacttgaatacagttgtagctagtcccacttttataataaaagcttccaaactctttatcataaactttgtctgtgagcttgggaatacagagaaagcaagttgatcattctgagacccttcctcatttgccctgaatcagttccccaagattggactgtactttaagctagttgttgtagcagtggtggttgttgttttatatcttgagatacttctagaacattctagaaacagggtattctaaaggcttactttatatgccatcctttttgaaccctcttattttagaaattattacacgtgcacacttatgatttcaaccttgtaaaataatttcaaattcatttcgtatccacattttactgcagtttccctatcatcatctcaatagttatagaactggttgaaattaaactgttttgaactaagaagtagatatatatatatatatatatatatatttttttttttttttttaaagagtgttcatagataaactctggcataaagtttgtaaaaaagcaattttttaaaagcaaaacgtataacctcaggtacaaaaatattgcatgcattagtattgcaaatttgcctactcaaatattaaccaaagcatgcaagataacttgactgaatttaaatttacacagtgcatgattaagtctcataggttagcctgttgttccttgcctctatacaagggagcatttttatgaactttgtgttacagtttttctatttgcttttcttatcctatccttgagattgttttcatgctatcacactgaactttacagatattcacacatctggtttctacagtgttaccagtgccaaactaatcctctgaagaatctgggacatctaaacactttttcaaaaaccagttgaggcacaacagatcccaaacttaaacaaatccaagtgtctgaatgctactaaactaaatcatgttgactgcctcagcacataaaggtttcgactttaaattcttaataatgcatttcaaaatttttctaaaagtttgggaataaattagaaaaactgatattctaaataaggcgaggaggttggggtaatgtcaggcacatcaaaatcatcacacaacgaagtagatatggggccttaattttcataaatgtcacatagcaagtgtgtggggtatcacaacattgttctgatacagccctgtttgtatggtagttgagctgcttgggctaaatgtcccttgagaaactggacttgatcaacaggtctaaaaacactgatatttagggagtgatgaggtgatttcacggtcactcagaaccaactctgaaatcttctcactgccttttcccataacccctattttatgaggagaccagaaagggagagagcaaagctcagtgagaccatgtggtcttacattagtaacagctttgttactcactccatataccccggtaccctcacacacataccatgaactcaaagacagaattctacacataacacacatagcaaagacgattgtggggaggcattaaacagttaagaggaaaaaaaaaaacacagaaaattaaactgtgaggtttaacaacctctcatgtggtattttgccttgaacgaagtttccactacctgcagcttctgcagaaataccaaaataacacagtctagagacaagtgtcccaatgtcagaactgttttctcaggaccttctctataagagaaaactaacttgcaatgctgcagaatgtcagagcaaaaccctgatgagctccgtgggatacttaatagaagcctgcactcaaaataatattaagatggaaacaacaacaacaattaggcagttctttgctcaactataaaatgtgtatcattcattgggggagggggaggggtcgtgttctttggatttcttggaaagggaaatggtataacacaaaaagactaagaggtatacacactcagctcggtaattcgagcatttggcattttcactgagatatatagcatttctgcatggataccatacaagaattctgccatgtgagaaatgtgttcatgatggactacattaccagtagttaagggaaatacagcaaacttaagtttttaccaacttcctttcatgttccctatatatcatctaacccaaactttcaatttacattgcccaaatttgtttacattggttgaaaaaaaactgattaatttattaaactttttacaaactgtaacaaacatttaactatttagaaaagacatttctacatattttatatatctatgaatattgcatctctaatctaatctaaaaatgttgttttgagacaattcttctgtgatgcttcctcctcatgctcataaatgtttaaagtcttgggatttcattttcaggctgaaatagataacaagaaaaaaatttaagtttaaatgtttacattgcgttactaaattaataccaattcaaattaagtgacctatagtaaattaatggcaatgggggggaggggattttaaagtgattggcatattatgtgatactgtatcagtgatttagtgaaataatatgtatcatagcacaactctgttgggtattaaggcttcatcttagtatttccctgcgttgctctttgaaataaaattactaccataaaaataacctcttatcatattgatgtgtttaatttactcagttggcttctaatttgcgtaacaagattaaggtagtatttttgtactattattggaagcatgccttccctttttcacattattaaattgtatttatatttgtgcaattttaaactatgttttcaaataaactttgtctgcggcttcgaggtcttttcaggaatctttcaaaatgggatttggggatcagaactccttctgatcaaatggaatccaatttgtactactggctaaaggtccttttattaaatattgaatatcactacatatgattttgcatgagctatctggaaatcaggaatgcatttttggatataaaacaaaactttaaaaatcttcctcctttgttaattttttaagactaaaatattatttaacctgaaattgaattttgtgattctttttagaataaaaatattaaaataaa

SEQ ID NO: 164558 - DNA, 1817 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000464614
  CDS Start-End: 172-1728
gagctaagcaaagtgggaagctgagtgcttgaaagaggattatgctcgcactagaaataagcaaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggat

SEQ ID NO: 164559 - DNA, 584 bp, Homo sapiens
  Payload ID: 12419
  Gene Symbol: PEX5L
  Gene Name: peroxisomal biogenesis factor 5-like
  ENST ID: ENST00000469198
  CDS Start-End: 2-584
gatgtctgacagtgaaatggatggaaggacccacattccatctctacttaatgcccttttgtccagaaaccgggtcatgcaaatgagctacttgaaaagtaaagaacaaggatatggaaaactaagcagtgatgaagacctcgaaataattgttgatcaaaagcagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaa

SEQ ID NO: 164560 - DNA, 2235 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000472994
  CDS Start-End: 361-2064
gagagacatgaggcaacctggcaggaagcgagaaagagttcggcgaagaaggagtgagttctagagacgccccgcgagcaggacccgcgcctgcaggagagcctggccgacccggctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatcc

SEQ ID NO: 164561 - DNA, 2992 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000485199
  CDS Start-End: 455-2230
gagaacggcgcgcgccccgctcggcagctgcggcggcggctggtgtaggcgctcacgtcagggctgggaggagggggttcgcagctcagagagagagagacatgaggcaacctggcaggaagcgagaaagagttcggcgaagaaggagtgagttctagagacgccccgcgagcaggacccgcgcctgcaggagagcctggccgacccggctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagaaaagtaaagaacaaggatatggaaaactaagcagtgatgaagacctcgaaataattgttgatcaaaagcagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtt

SEQ ID NO: 164562 - DNA, 2309 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000468741
  CDS Start-End: 695-1999
cacttggaaggtggagagattagctttctttttccttctagttcagtcctttggctactgtgaaagaccacgcagaagctgtggacttgctttttgtgcttgacaaaagtgcatagatagaagacagggattcccggctgggaggagggaggagagctgaagatccctgcctgggctggctgagctaagcaaagtgggaagctgagtgcttgaaagaggattatgctcgcactagaaataagcaaaaagtaaagaacaaggatatggaaaactaagcagtgatgaagacctcgaaataattgttgatcaaaagcagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttcttt

SEQ ID NO: 164563 - DNA, 472 bp, Homo sapiens
  Payload ID: 12419
  Gene Symbol: PEX5L
  Gene Name: peroxisomal biogenesis factor 5-like
  ENST ID: ENST00000496721
  CDS Start-End: 262-472
actatacacaagtggcttcttccctgctatgcaccagtggcatgcacaaaccaaaaagaagcagaatgatctgaaaaactggtgaatgagcaacaagaaagcagacccctcctgagtccctccatcgatgactttctctgtgaaaccaaatcggaagcaatagcaaggccagtaacatccaatacagctgacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttag

SEQ ID NO: 164564 - DNA, 2147 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000465751
  CDS Start-End: 328-2136
aagagttcggcgaagaaggagtgagttctagagacgccccgcgagcaggacccgcgcctgcaggagagcctggccgacccggctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataa

SEQ ID NO: 164565 - DNA, 874 bp, Homo sapiens
  Payload ID: 12419
  Gene Symbol: PEX5L
  Gene Name: peroxisomal biogenesis factor 5-like
  ENST ID: ENST00000463761
  CDS Start-End: 264-874
ctttggctactgtgaaagaccacgcagaagctgtggacttgctttttgtgcttgacaaaagtgcatagatagaagacagggattcccggctgggaggagggaggagagctgaagatccctgcctgggctggctgagctaagcaaagtgggaagctgagtgcttgaaagaggattatgctcgcactagaaataagcaatctgtggttctctggtcagcaagttctggcaaggaagccactgccagtggcataaagaattctgggatgtctgacagtgaaatggatggaaggacccacattccatctctacttaatgcccttttgtccagaaaccgggtcatgcaaatgagctacttgaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgt

SEQ ID NO: 164566 - DNA, 563 bp, Homo sapiens
  Payload ID: 12419
  Gene Symbol: PEX5L
  Gene Name: peroxisomal biogenesis factor 5-like
  ENST ID: ENST00000491640
  CDS Start-End: 460-563
agaggaattaagccaaacatactctagtggagctgtctatattacaccaaacaaattgaataatgctgaagtgttggccagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccct

SEQ ID NO: 164567 - DNA, 9082 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000467460
  CDS Start-End: 332-2212
gagaaagagttcggcgaagaaggagtgagttctagagacgccccgcgagcaggacccgcgcctgcaggagagcctggccgacccggctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaacaaaaaagactccacagaattgggatcaaaacagtctaattggctggggaataagcttctactgaggagtaaatgtgcacacgtgcttatcaattgaatgcgaggtacaggaataaaatcctctcctctgttacatctgaagtccttgggttgtgagagggcctcaagttaacagaaaccacaagtccttgaggcttacatatgttataacctattctagtttataaagacaaaaagctgaggccactgtgaggagtgccaggttttgatagtcattgtcaaagttgacttgggccaggtggtagctccagctggtcagcagaaggcagaggcattcaggcactcatcatgggtagcagcgaccacccagtctcagaccgtgcttctctacagtctcagcagcaaagtaaagctcaacaatgctttcaagaatggtattgtaagaattgtagaattcgagaaacccagtctggtaaggactcttggggccagcctccaagccatggcagggcctgcttgaatatgcctgattaagcatcctttccttccctgctccttcctcctgccatctctgtaccttgaccagaaagtcggcatgaatagttcatggacaaaggattgaatagcctctgaacaaaggattcaaagcaaactttgtaagtgttctgtgatgccattctatactttgagcagcagctgaatctgcagcctggatttaaagcctgaaactagtataaatgtcaaataattaatttgttgctaaatggtggcaaattttgtggcccaagttttattttgctattggaacacaaactccaaggagctgttttagggaagactaaacaatcttccattcttaccattatttggcaatttgcagagcatttagtagtactttctctagtgtatgtagtatctgtcagatctaagatttttataggctgtcaagaagtccagaattacggcccaagaggaaaagagttgcatttttcaataatattttttataaaattaagttaaaaccattattaaaacatgagtgacaggccaggtgcggtggctcacgcctgtaatcctagcactttgggaggcagaggcgggcagaccacgaggtcaggagttcgagaccagcctgaccaacatggtgaaaccccgtctttattaagaatacaaaaattagccgggtgtagtggtatgcacctgtaataccagctactcaggaggctgaggcaggagaatcacttgaaccagggaggcggaggttgcagtgagccgagattgcaccgctgcactccagtctgggtgacagagcgagactccgtctcaaaaaaaacaaaaaagtgacagtttataggaatagagcaccaccaagaaatcagtagcaagactttagaacagtctttttgtataaatcatatacagtaaatgttttgtttcttagaagtgcatctactttattttttggcagaacaatttttggcatcttatcttcatggcatgaaattgtcatttaaattactctttccgtttgaaaggggagggtatccttatttcccttctgaggtactctgagaaggctttgagtttcctttttcatgtattaatgtataacagcctaacagctcctagaagagggtattcttactagaatggctacatacgggtgacttcagttacatacaggtgacttccagggactgacttcgcctgtagattggatgaaaataaagagaaagccagtgattattgctgagtttcaaaatataaccatttctagtaggctacttctacatgctgttgtaccttcctggtgaggaggagacagagggataggggagaggaggaggaataaaaatccctctcactgggccaatcatactgattcattccctttacttcctccaaaactcactccccatgactcctgaaaaatgggtagatctcgtccaccaggaaattttaatagaatactatgcaccgtgctttctcagtcaatctggattcctactagaacagaaaagtaaggaaacataactgggtaggaatgtccacttacgtttcacaaactcacttttagagtttcatgccactttcctcattcttctctttaagatactattatattgaacgtgggacccatgtctaaatacttgtatagataaatatttcttgtatattcttcccatacaagcaagacttgaatacagttgtagctagtcccacttttataataaaagcttccaaactctttatcataaactttgtctgtgagcttgggaatacagagaaagcaagttgatcattctgagacccttcctcatttgccctgaatcagttccccaagattggactgtactttaagctagttgttgtagcagtggtggttgttgttttatatcttgagatacttctagaacattctagaaacagggtattctaaaggcttactttatatgccatcctttttgaaccctcttattttagaaattattacacgtgcacacttatgatttcaaccttgtaaaataatttcaaattcatttcgtatccacattttactgcagtttccctatcatcatctcaatagttatagaactggttgaaattaaactgttttgaactaagaagtagatatatatatatatatatatatatatttttttttttttttttaaagagtgttcatagataaactctggcataaagtttgtaaaaaagcaattttttaaaagcaaaacgtataacctcaggtacaaaaatattgcatgcattagtattgcaaatttgcctactcaaatattaaccaaagcatgcaagataacttgactgaatttaaatttacacagtgcatgattaagtctcataggttagcctgttgttccttgcctctatacaagggagcatttttatgaactttgtgttacagtttttctatttgcttttcttatcctatccttgagattgttttcatgctatcacactgaactttacagatattcacacatctggtttctacagtgttaccagtgccaaactaatcctctgaagaatctgggacatctaaacactttttcaaaaaccagttgaggcacaacagatcccaaacttaaacaaatccaagtgtctgaatgctactaaactaaatcatgttgactgcctcagcacataaaggtttcgactttaaattcttaataatgcatttcaaaatttttctaaaagtttgggaataaattagaaaaactgatattctaaataaggcgaggaggttggggtaatgtcaggcacatcaaaatcatcacacaacgaagtagatatggggccttaattttcataaatgtcacatagcaagtgtgtggggtatcacaacattgttctgatacagccctgtttgtatggtagttgagctgcttgggctaaatgtcccttgagaaactggacttgatcaacaggtctaaaaacactgatatttagggagtgatgaggtgatttcacggtcactcagaaccaactctgaaatcttctcactgccttttcccataacccctattttatgaggagaccagaaagggagagagcaaagctcagtgagaccatgtggtcttacattagtaacagctttgttactcactccatataccccggtaccctcacacacataccatgaactcaaagacagaattctacacataacacacatagcaaagacgattgtggggaggcattaaacagttaagaggaaaaaaaaaaacacagaaaattaaactgtgaggtttaacaacctctcatgtggtattttgccttgaacgaagtttccactacctgcagcttctgcagaaataccaaaataacacagtctagagacaagtgtcccaatgtcagaactgttttctcaggaccttctctataagagaaaactaacttgcaatgctgcagaatgtcagagcaaaaccctgatgagctccgtgggatacttaatagaagcctgcactcaaaataatattaagatggaaacaacaacaacaattaggcagttctttgctcaactataaaatgtgtatcattcattgggggagggggaggggtcgtgttctttggatttcttggaaagggaaatggtataacacaaaaagactaagaggtatacacactcagctcggtaattcgagcatttggcattttcactgagatatatagcatttctgcatggataccatacaagaattctgccatgtgagaaatgtgttcatgatggactacattaccagtagttaagggaaatacagcaaacttaagtttttaccaacttcctttcatgttccctatatatcatctaacccaaactttcaatttacattgcccaaatttgtttacattggttgaaaaaaaactgattaatttattaaactttttacaaactgtaacaaacatttaactatttagaaaagacatttctacatattttatatatctatgaatattgcatctctaatctaatctaaaaatgttgttttgagacaattcttctgtgatgcttcctcctcatgctcataaatgtttaaagtcttgggatttcattttcaggctgaaatagataacaagaaaaaaatttaagtttaaatgtttacattgcgttactaaattaataccaattcaaattaagtgacctatagtaaattaatggcaatgggggggaggggattttaaagtgattggcatattatgtgatactgtatcagtgatttagtgaaataatatgtatcatagcacaactctgttgggtattaaggcttcatcttagtatttccctgcgttgctctttgaaataaaattactaccataaaaataacctcttatcatattgatgtgtttaatttactcagttggcttctaatttgcgtaacaagattaaggtagtatttttgtactattattggaagcatgccttccctttttcacattattaaattgtatttatatttgtgcaattttaaactatgttttcaaataaactttgtctgcggcttcgaggtcttttcaggaatctttcaaaatgggatttggggatcagaactccttctgatcaaatggaatccaatttgtactactggctaaaggtccttttattaaatattgaatatcactacatatgattttgcatgagctatctggaaatcaggaatgcatttttggatataaaacaaaactttaaaaatcttcctcctttgttaattttttaagactaaaatattatttaacctgaaattgaattttgtgattctttttagaataaaaatattaaaataaa

SEQ ID NO: 164568 - DNA, 2361 bp, Homo sapiens
  Payload ID: 12419
  Gene Symbol: PEX5L
  Gene Name: peroxisomal biogenesis factor 5-like
  Uniprot ID: Q8IYB4
  ENST ID: ENST00000476138
  CDS Start-End: 305-2056
ctttggctactgtgaaagaccacgcagaagctgtggacttgctttttgtgcttgacaaaagtgcatagatagaagacagggattcccggctgggaggagggaggagagctgaagatccctgcctgggctggctgagctaagcaaagtgggaagctgagtgcttgaaagaggattatgctcgcactagaaataagcaaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgt

SEQ ID NO: 164569 - DNA, 2696 bp, Homo sapiens
  Payload ID: 12420
  Gene Symbol: PEX6
  Gene Name: peroxisomal biogenesis factor 6
  Uniprot ID: Q13608
  ENST ID: ENST00000244546
  CDS Start-End: 1-2217
atggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaaggtggagaccaagtccttggagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggagccaggtagctcagcactgatgctcaccatggaggacttgctgcaggctgccgcccggctgcaaccctcagtcagtgagcaggagctgctccggtacaagcgcatccagcgcaagtttgctgcctgctag

SEQ ID NO: 164570 - DNA, 3478 bp, Homo sapiens
  Payload ID: 12420
  Gene Symbol: PEX6
  Gene Name: peroxisomal biogenesis factor 6
  Uniprot ID: Q13608
  ENST ID: ENST00000304611
  CDS Start-End: 71-3013
acactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggagccaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggagtgagaaagagcagggttgtgggaggagtaagccctgggagagggtgggggggtgggcagcatgggagcctgatccttctgacataaataaacacaatgcatgcaggaactg

SEQ ID NO: 164571 - DNA, 1464 bp, Homo sapiens
  Payload ID: 12421
  Gene Symbol: PEX7
  Gene Name: peroxisomal biogenesis factor 7
  Uniprot ID: O00628
  ENST ID: ENST00000318471
  CDS Start-End: 82-1053
tctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcaggtgatcagactctgagaatatgggatgtgaaggcagcaggagtaagaatcgtgattcctgcacatcaggcagaaatcttgagttgtgactggtgtaaatacaatgagaatttgctggtgaccggggcggttgactgtagtttgagaggctgggacttaaggaatgtacgacaaccagtgtttgaacttcttggtcatacctatgctattaggagggtgaaattttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttataa

SEQ ID NO: 164572 - DNA, 680 bp, Homo sapiens
  Payload ID: 12421
  Gene Symbol: PEX7
  Gene Name: peroxisomal biogenesis factor 7
  ENST ID: ENST00000367756
  CDS Start-End: 88-456
gcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggagtatgttcagggaagctgtgttgtgaaatagaagagcaactaatgggtcattttcttctgtggaagagagtatataataaagacgtatagcatggttttagtcaatcttggatttgaatcccagctttgtaagttacctgttgtgagaccttgcgtatgtcacatatttttcctaaacttgagtgtttttatttgcaaactaagtttattagtagtctgtatcacagaccagcattgaataaatatgagctagta

SEQ ID NO: 164573 - DNA, 945 bp, Homo sapiens
  Payload ID: 12421
  Gene Symbol: PEX7
  Gene Name: peroxisomal biogenesis factor 7
  Uniprot ID: O00628
  ENST ID: ENST00000541292
  CDS Start-End: 103-945
acttccgtccggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcaggtgatcagactctgagaatatgggatgtgaaggcagcaggagtaagaatcgtgattcctgcacatcaggcagaaatcttgagttgtgactggtgtaaatacaatgagaatttgctggtgaccggggcggttgactgtagtttgagaggctgggacttaaggaatgtacgacaaccagtgtttgaacttcttggtcatacctatgctattaggagggtgaaaatggagtcttgccctgtcacccagacacgatctcagctcactgcaacctctgccttctgggttcaagctgttctcctgcctcagcctactgagtag

SEQ ID NO: 164574 - DNA, 957 bp, Homo sapiens
  Payload ID: 12422
  Gene Symbol: PXMP2
  Gene Name: peroxisomal membrane protein 2, 22kDa
  Uniprot ID: Q9NR77
  ENST ID: ENST00000317479
  CDS Start-End: 66-653
gggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacctgctcttcctgcggctctacccggtgctcaccaaggcggccaccagtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttcttcaatggtga

SEQ ID NO: 164575 - DNA, 762 bp, Homo sapiens
  Payload ID: 12422
  Gene Symbol: PXMP2
  Gene Name: peroxisomal membrane protein 2, 22kDa
  ENST ID: ENST00000428960
  CDS Start-End: 1-682
gcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagccagggtccccaggaccactcccacactgggaggatggggtgcagcaccccctgcagcatggcaggatacccccagatgctacaggaggaggcctggcagagcctgcaggggccacgtgcttccctcccccagaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccc

SEQ ID NO: 164576 - DNA, 516 bp, Homo sapiens
  Payload ID: 12422
  Gene Symbol: PXMP2
  Gene Name: peroxisomal membrane protein 2, 22kDa
  ENST ID: ENST00000539093
  CDS Start-End: 1-148
tggcattttgtcagcacttgggaacttcctggcccagatgattgagaagaagcggaaaaaagaaaactctagaagtctggatgtcggtgggcctctgagatatgccgtttacgggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgcccca

SEQ ID NO: 164577 - DNA, 632 bp, Homo sapiens
  Payload ID: 12422
  Gene Symbol: PXMP2
  Gene Name: peroxisomal membrane protein 2, 22kDa
  ENST ID: ENST00000543589
  CDS Start-End: 30-512
gcccccggcggcacggcgctggggaggcgatggcgccggccgcgtccaggctgcgggccgaagccgggctcggggcgctgccgcggcgggcgctcgcccagtacctgctcttcctgcggctctacccggtgctcaccaaggcggccaccagtggcattttgtcagcacttgggaacttcctggcccagatgattgagaagaagcggaaaaaagaaaactctagaagtctggatgtcggtgggcctctgagatatgccgtttacggttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcgctgccttcaggtggtgctgccccagaaacttaaaatttagtcgaggcagtttcaattgttactgtggaccgaattaggatcacaataaacgataatgcaggttcttcaa

SEQ ID NO: 164578 - DNA, 537 bp, Homo sapiens
  Payload ID: 12422
  Gene Symbol: PXMP2
  Gene Name: peroxisomal membrane protein 2, 22kDa
  ENST ID: ENST00000454379
  CDS Start-End: 1-252
cctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaaggtgagggccacggggctcagcctctgctaacattactttgtcagccttttccttccttccttccttcctctttcctccccccctccctcccctcttcttttctcttctcttctttctttggtagttttccgctagacttagtttcatccgtgtctagactcctcaactacccttggattttgcccatgaccctgaatcattgctagttcgggattcaggaagcaacagagaagggtgtcccgagtggtcgtctttgcctcttctgttcgttcagcaaattctcattaaaagcccccatgccagggatgcctatga

SEQ ID NO: 164579 - DNA, 979 bp, Homo sapiens
  Payload ID: 12423
  Gene Symbol: PXMP4
  Gene Name: peroxisomal membrane protein 4, 24kDa
  ENST ID: ENST00000217398
  CDS Start-End: 104-538
acgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcaggggcacctgtgtttgtgcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggtt

SEQ ID NO: 164580 - DNA, 989 bp, Homo sapiens
  Payload ID: 12423
  Gene Symbol: PXMP4
  Gene Name: peroxisomal membrane protein 4, 24kDa
  Uniprot ID: Q9Y6I8
  ENST ID: ENST00000344022
  CDS Start-End: 113-328
atagacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactg

SEQ ID NO: 164581 - DNA, 5684 bp, Homo sapiens
  Payload ID: 12423
  Gene Symbol: PXMP4
  Gene Name: peroxisomal membrane protein 4, 24kDa
  Uniprot ID: Q9Y6I8
  ENST ID: ENST00000409299
  CDS Start-End: 94-732
ggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcactgtggctcactcctgtaatctcagaactttgggaggctgaggcaggtggatcacttgagctcaggagcttgagaccagcctgggcaacatggtgaaacccagtttctacaaaaaatacaaaaaattagccgggttccatcacctgtggttccagctgaggtgggaggatcacttgagcctatgaggtcgaggctacagtgagcaaagatcacgccactgcactccagcctgggcgacagtgagaccctgtctcaccaaagaaaaaaaaaaggtgagattaatcttcactatatattttaacacaaatttctaaaagttatttcaacatataattaacatcattagatattttgtactcttttttgtattaagtattcaaaattgggtgtatattttgccacccacattttcaggacccagtagccacatgtggctagtggctgctgtgacgggcaacacagatatggaacacttgtatcctcacagattattctagtggacagtgcagatctagagctagaggacatgggtttgagtccccactcccccactgtgtaaccttggggaaggttctggacctctcagagcctcaatttatcataaaatgaggataatcataatgccgtggtcctcactggacttgtgcaactaccactgatgtgctactaattactttcatttagtgcattcatacttccacttgggtgttttccacatattattattattttttttttttaagtagcgacagggtctcgctctgtcactagggctagtctcgacctcctagcctcaagcaatcttcctgcctcagtctcccaaagtgccatgattacaggcatgagccactgcccctagcctgcacatattatttttaaaccatacagtggccttgcaaatgtgtgttttcgtccccattttacagatgtagaaactgagggtcaggccaggtgcagtggctcacgcctgtaatcccagcactttgggaggctgaggcaggcagataacctgagatcaggagttcttgaccagcctggccaacatggtaaaaccccatctctactaaaaatacaaaaattagccaggcatggtggcacgtccctgtaatcccagctactggggaggctgaggcaggagaatcgcttgaacctgggaggcagaggctgcagtgagctgagatcgcacgactgcactccagcctgggccacagagcgagactgtgtctaaaaaaaaaataaaaaaagaaaagaaaagaaactgagaatcagagaggagagtaacttgcccaaggtaatacagctagtataacagccgaatcaagatttgaactcagattcgtctgatttcaaagcccatgttttttccagtgccttgtttcaaatttagaaacctaagccatgctatgcaaatgttagctcattataggatatgggccagaaaggggtacacattcaaatgcccataggggcctacaatgacatagtgctatgcgatgaggagtgatggggacatagggaactggagacttgtgtaccagtctgattttttcttttttttttttttttgagacagagtcttgctctctcgcccaggctggagtgcagtggcgcgatcttggctcactgcaagctctgcctcccaggtttacttacaccattctcctgcctcagcctccggagtagctgggcctacaggtgcccgccaccacacccggctaattttttgtatttttagtagagatggggtttcaccgtgttagccaggatggtctcaatctcctgacctcatgatccacccaccttggcctcccaaaatgctgggattacaggtgtgagccaccatgcctggccaagtctgcttttttcgaaaccacgatcctagaccaggcacggtggcttgcacctgtaatcccagcactttgggaggccgaggcgggtggatcacctgaggtcaggagttcgagaccagcctggccaacatggcgaaatcctgtctctactaaaaatacaaaaattagctggacatggtggcaggcacctgtaattccagctacttgggaggctgaggtgggagaatctcttgaacctggggggctgctgtgagccgagatagttccattacacttcagcctgggtgacagagtaagactctgtctcaaaaaaaaaaaaaaaaaaaaaaacacaatcctggacaaatcaaacaagtctccaggaaaatctggtccatgggctaccaatttgagaccattggtctggtagatacactttcattaatatacttactccatcactctttctatattttagaagttactagtagaaatgtatgcaggagtcactggagaccttattaaaatgcagcttctgattcagtgagctggggtggggcctgagagtctgcatttctcccaggctccctggtgctgccagtggtgctgctctgagtaacaagggggtggggaatgatatggagccgtccattattatcccatctgacaaatgagtcacagagcccttaggtaattgaggtgggatcagtctgattctgtaagctgtgttttcagccacaacatttactgcaaacttggagtaggtaattatgaagttcctttaacttgctgtggaggttgaatgagctctagagtaaggggtccgcaaccccggtaccggtccatggcctgttcggaaccaggccacgcagcaggagttgaaaggtgggtgagctagcgaagcttcatctgtatgtacagccactccccactgctcacattaccacctgagctctgccttctgtcagatcagtggtggcattagatgctcgtaggaatgcaaaccctattgtgaactgcgcatgcaagggatctaggttgcatgctccttatgagaatctaatgcctgatgatctgtcactgtctcccgtcacgccttgatgggactgtctagttgctggaaaacaaactcagggctcccactgattctacattatggtgtgttgtacaattatttcattatatattacaaggtaataataatagaaataaaatccacagtaaatgcaatgtgcttgaatcatcctgaaaccacgtcccctccccagtggtccgtggaaaaattatcttccccaaaactggtccctggtgccaaaaaggttggggactgctgctctaggggttggggagggcagagggcttgggccatcaccaggcaggttttatagcagatggtgggggtgccctgcctatagctcctctaaataacgactctggtgcacactagccagctttgccagtggccgcccctctgtctttctgcctgaggactctagcttgtcactggtgcctcctttgccagcctctggcaggcctgaagggctggagaatgaacacatccttggagcaaccttcaaccaatgactgataaatacccccactcccacagcccgcatccctcacccctcgggtgggataactcagaggtgcgtgctccacactgactcccagggccgcccagcagggctgagcctcaaacaccctccccatctcccttcctcatgcccctaccagtgcttcctgggaccacttcccatatgaaccacttgcactcaaacccttgtcttagagtctgctattgggggaacccaaactaaaactggcctctgtacagcaggttgagaggcaatatagcatggtggtcagggacataggctttggagccagagtgcctgggctcaagccctggccccacagtttccttgggcaagtgactgagccattctgtgcctctatttcctcattgataaagtaggcgttgtcgtagcacacacctcatcgagtggtgtggagggttaaagaatatgacacagttaaagtgagtccccaataaatgctgttatttctaagagcatccaaatgtagaggaagtgtgcccctgaggactgagcacaccctgcttttagcctgtcctgcccccagctgaaggtgaaaccttggccgcctgccctcctgaagtcccgccactgctgctgggggttggccaactccgctaccgactgtctctgctctctaagaataggtttccctcacagatggcatctctctggatgctgctagagcatctggtgcttccaactgcacactccagggaggaaggcagtgtggtctgtgccggggagcagggctctgccttccagcagatctgagaggagtcccatttggctccttcctagctgccctccattctctaagacctgtaaaacagggatggccagagggctcttgttgcacagtaagtgctatgcttcctaaatgctagttcctgaaatagaatggtttaacctctacttactaaacacctgctacaatcctgttaattcttttgacatgtaagactaaaataaataaataaataaataaatata

SEQ ID NO: 164582 - DNA, 1853 bp, Homo sapiens
  Payload ID: 12424
  Gene Symbol: PECR
  Gene Name: peroxisomal trans-2-enoyl-CoA reductase
  Uniprot ID: Q9BY49
  ENST ID: ENST00000265322
  CDS Start-End: 76-987
tccgcccgcccgcctcgaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaa

SEQ ID NO: 164583 - DNA, 1100 bp, Homo sapiens
  Payload ID: 12424
  Gene Symbol: PECR
  Gene Name: peroxisomal trans-2-enoyl-CoA reductase
  ENST ID: ENST00000442122
  CDS Start-End: 50-523
gagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcaggcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttgtgataacaatccatattcctcatttggagcaactctggtgagggatgatgagaagaatttatggagtatgccccatgatgtgtcccacacagaggcagacgacgacagaaccctgtacaatttgatagtcattcgta

SEQ ID NO: 164584 - DNA, 2108 bp, Homo sapiens
  Payload ID: 12425
  Gene Symbol: PXT1
  Gene Name: peroxisomal, testis specific 1
  Uniprot ID: Q8NFP0
  ENST ID: ENST00000454782
  CDS Start-End: 485-889
ggggccgcaccgtaaatgggtgtcgcctttcctccagtccactctgcacccaacctcagcgggcgcacttttctgagttgcgcataccctctcaattattaaaggttgcagacggaaaagttagtagttttcggaattgtagaatacgctcgtgcagcgccaggacggctaatgcttacccgaaaatgtggaaccctgatctccccatgcgtggagcgaggttggaggtagcgtagtaagaatactggagttgcttaaacgcatttgctcgaaagtcactaccctggatatacattctggccaaaagaaagggggaaaaactccacatttttctcaaatactgagtttcatgaagagaacctccaacaaatggtatataaaggaaaacaaagcaaacaaaagagggaaactttgcaatttattaactcaagcatgaaaatacagaaaataaagagggctcaacatacttggaaaaggaaaaaacatgaagaaaaaacatgatggcattgtttatgaaactaaagaagttctcaatccatctcccaaagtaacacattgttgcaaatcactgtggttaaaatacagttttcagaaggcatacatgacccaacttgtcagctcccagccagttccagccatgtcaaggaacccagatcataatctactttctcagcccaaggagcatagcattgttcagaagcatcaccaggaggaaataattcacaagttggccatgcagctgagacacattggggacaacattgatcataggatggttcgagaggatcttcaacaggatggcagagatgcactagatcattttgtcttctttttctttagaagagttcaggtgttgctgcattttttctggaacaaccatttgctgtaaaaggaaagtaaaggtcaagtggtcaagttctgttttctttttaccctctgagaaacatgaatcccactgggacagatgggaagaacacccttctccgtctccctctttttgtacccatcactgttggtctacacccagtttgttgaagaactgcgggttcacgagccatttgtctcttcggaggagctagctatgagatgtctgcgatcacatcacggtaaagcccaaggagtaattaggaccccaggaagccttgctgcccagaaaacaccagcgctgtggatggtcccagggctccttgtgaggaaaccttgaacatttccttccaggaatgaaagagaacctcgtcctcaaactaaaggccacagaaatgggcactacctcctggcccactccctgggcaccatgccctctggtgacctgttggctccactcttgtcactcatgtccagatctgcagtgccagcttctccttctcggtgacatgtcacctccctgccccaatcctggctccaaccctctctggaaaatcgaagtgaaacatttgtctctaatactcaaattcaacatatggctcatctcatctaccttcccatttccatgcctagaggccccactactaccactagcaccgttgggtgtttccttctcaggctctgattctacaacatttacgttcttttctcacctttgatcccctcactcctctgtgacccccttcaagtcttccttcaccactccagtgttttcccataccactcgaccctgctcgaaggtatctttccctgctctgtcatcctcttttaggcatgcctgcttaaaatcgggagtgcttagtccttggccaacagtcctgccttctagaagaatgtaagacctgaaagagttatgaatctatcactaggcaaaaacttctcttttcctattgctggatggttttgctattattggttggtgggccctttgcctgtggaatgtatttcactcattctctcctgcacgctgttaggcagttctttcacctgcatgcttcttcttttacctttttgtctacctcatagtccctctctcccctcctttaaaagaattataaatattaggaaagcttgttgttataaattaaaagtttacatatgtatcttgagttcttcataggggaagtgttattttaaaaaattctaaaaatgaaataaatattgttattttattgagcatgaaa

SEQ ID NO: 164585 - DNA, 619 bp, Homo sapiens
  Payload ID: 12425
  Gene Symbol: PXT1
  Gene Name: peroxisomal, testis specific 1
  ENST ID: ENST00000619547
  CDS Start-End: 21-176
aaataattcacaagttggccatgcagctgagacacattggggacaacattgatcataggatggttcgagaggatcttcaacaggatggcagagatgcactagatcattttgtcttctttttctttagaagagttcaggtgttgctgcattttttctggaacaaccatttgctgtaaaaggaatgaaagagaacctcgtcctcaaactaaaggccacagaaatgggcactacctcctggcccactccctgggcaccatgccctctggtgacctgttggctccactcttgtcactcatgtccagatctgcagtgccagcttctccttctcggtgacatgtcacctccctgccccaatcctggctccaaccctctctggaaaatcgaagtgaaacatttgtctctaatactcaaattcaacatatggctcatctcatctaccttcccatttccatgcctagaggccccactactaccactagcaccgttgggtgtttccttctcaggctctgattctacaacatttacgttcttttctcacctttgatcccctcactcctctgtgacccccttcaagtcttccttcaccactccagtgttttcccataccactcgaccctgc

SEQ ID NO: 164586 - DNA, 9965 bp, Homo sapiens
  Payload ID: 12426
  Gene Symbol: PPARA
  Gene Name: peroxisome proliferator-activated receptor alpha
  Uniprot ID: Q07869
  ENST ID: ENST00000262735
  CDS Start-End: 183-1589
gcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 164587 - DNA, 1558 bp, Homo sapiens
  Payload ID: 12426
  Gene Symbol: PPARA
  Gene Name: peroxisome proliferator-activated receptor alpha
  Uniprot ID: Q07869
  ENST ID: ENST00000402126
  CDS Start-End: 129-1535
cacagttctggaggctgggaagttcaagatcaaagtgccagcagattcagtgtcatgtgaggacgtgcttcctgcttcatagataagagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacacct

SEQ ID NO: 164588 - DNA, 9995 bp, Homo sapiens
  Payload ID: 12426
  Gene Symbol: PPARA
  Gene Name: peroxisome proliferator-activated receptor alpha
  Uniprot ID: Q07869
  ENST ID: ENST00000407236
  CDS Start-End: 214-1620
ccaggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaattt

SEQ ID NO: 164589 - DNA, 368 bp, Homo sapiens
  Payload ID: 12426
  Gene Symbol: PPARA
  Gene Name: peroxisome proliferator-activated receptor alpha
  ENST ID: ENST00000440343
  CDS Start-End: 342-368
gggccgtggacgcggcggccccgcggcgggggcagcgggcggcgggggcggaggcggccgctagcgccctgcccggcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgatggtggacacggaaagcccactctgc

SEQ ID NO: 164590 - DNA, 531 bp, Homo sapiens
  Payload ID: 12426
  Gene Symbol: PPARA
  Gene Name: peroxisome proliferator-activated receptor alpha
  ENST ID: ENST00000415785
  CDS Start-End: 324-531
gcagcgggcggcgggggcggaggcggccgctagcgccctgcccggcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagtgccacacccccctgtcccagtgcactggggctgtggatcccttcaaagctgagattgcctgtctgtggtctccagcgttaagcacagtcattagctcagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacgg

SEQ ID NO: 164591 - DNA, 572 bp, Homo sapiens
  Payload ID: 12426
  Gene Symbol: PPARA
  Gene Name: peroxisome proliferator-activated receptor alpha
  ENST ID: ENST00000420804
  CDS Start-End: 173-572
cttcggcgttcgccccacggaccggcaggcggcggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaaggtagaggggagctggaacagggcctggtggc

SEQ ID NO: 164592 - DNA, 3774 bp, Homo sapiens
  Payload ID: 12427
  Gene Symbol: PPARD
  Gene Name: peroxisome proliferator-activated receptor delta
  Uniprot ID: Q03181
  ENST ID: ENST00000311565
  CDS Start-End: 350-1675
ggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcagtgatctctacaggactgcttcaaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaa

SEQ ID NO: 164593 - DNA, 2041 bp, Homo sapiens
  Payload ID: 12427
  Gene Symbol: PPARD
  Gene Name: peroxisome proliferator-activated receptor delta
  Uniprot ID: Q03181
  ENST ID: ENST00000337400
  CDS Start-End: 350-1435
ggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcagtgatctctacaggactgcttcaaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgc

SEQ ID NO: 164594 - DNA, 3747 bp, Homo sapiens
  Payload ID: 12427
  Gene Symbol: PPARD
  Gene Name: peroxisome proliferator-activated receptor delta
  Uniprot ID: Q03181
  ENST ID: ENST00000360694
  CDS Start-End: 310-1635
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 164595 - DNA, 3453 bp, Homo sapiens
  Payload ID: 12427
  Gene Symbol: PPARD
  Gene Name: peroxisome proliferator-activated receptor delta
  Uniprot ID: Q03181
  ENST ID: ENST00000418635
  CDS Start-End: 310-1341
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 164596 - DNA, 3516 bp, Homo sapiens
  Payload ID: 12427
  Gene Symbol: PPARD
  Gene Name: peroxisome proliferator-activated receptor delta
  Uniprot ID: Q03181
  ENST ID: ENST00000448077
  CDS Start-End: 196-1404
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 164597 - DNA, 1850 bp, Homo sapiens
  Payload ID: 12428
  Gene Symbol: PPARG
  Gene Name: peroxisome proliferator-activated receptor gamma
  Uniprot ID: P37231
  ENST ID: ENST00000287820
  CDS Start-End: 122-1639
actcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 164598 - DNA, 1870 bp, Homo sapiens
  Payload ID: 12428
  Gene Symbol: PPARG
  Gene Name: peroxisome proliferator-activated receptor gamma
  Uniprot ID: P37231
  ENST ID: ENST00000309576
  CDS Start-End: 238-1671
cccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 164599 - DNA, 1329 bp, Homo sapiens
  Payload ID: 12428
  Gene Symbol: PPARG
  Gene Name: peroxisome proliferator-activated receptor gamma
  Uniprot ID: P37231
  ENST ID: ENST00000396999
  CDS Start-End: 1-561
atgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgaggaactacaaaaggatagttattagattgccaaatcctgcagaacctccagcaggcacaagttggtttttctccctcaagaaagagaagtgagccaagcgtggtggtgcatgcctgtggtcccagctactcaggaggctgagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggag

SEQ ID NO: 164600 - DNA, 1122 bp, Homo sapiens
  Payload ID: 12428
  Gene Symbol: PPARG
  Gene Name: peroxisome proliferator-activated receptor gamma
  ENST ID: ENST00000397000
  CDS Start-End: 69-821
gaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacc

SEQ ID NO: 164601 - DNA, 2017 bp, Homo sapiens
  Payload ID: 12428
  Gene Symbol: PPARG
  Gene Name: peroxisome proliferator-activated receptor gamma
  Uniprot ID: P37231
  ENST ID: ENST00000397010
  CDS Start-End: 385-1818
aacttacaaacgcaaggaactctgaaagtgtgcagcaccaccgatcagaagagaaaaccaagggacccgaaatatgctttaattaaattttcttttaaaatgtcactggaaagaacatcttgggaagacggcctggccgatcgccgtgtgaagggcaagccactctggccgagagggagccccacacctcggtctccccagaccggccctggccgggggcatccccctaaacttcggatccctcctcggaaatgggaccctctctgggccgcctcccagcggtggtggcgaggagcaaacgacaccagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 164602 - DNA, 2006 bp, Homo sapiens
  Payload ID: 12428
  Gene Symbol: PPARG
  Gene Name: peroxisome proliferator-activated receptor gamma
  Uniprot ID: P37231
  ENST ID: ENST00000397012
  CDS Start-End: 374-1807
ctttgtgggctcctgcaagtgccaggcgctgaccactcctcctgggagcctaactgaggggggtagaggcagcagaggttaacagaaatctcaggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 164603 - DNA, 1722 bp, Homo sapiens
  Payload ID: 12428
  Gene Symbol: PPARG
  Gene Name: peroxisome proliferator-activated receptor gamma
  Uniprot ID: P37231
  ENST ID: ENST00000397015
  CDS Start-End: 123-1556
gccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaattt

SEQ ID NO: 164604 - DNA, 2002 bp, Homo sapiens
  Payload ID: 12428
  Gene Symbol: PPARG
  Gene Name: peroxisome proliferator-activated receptor gamma
  ENST ID: ENST00000397023
  CDS Start-End: 25-147
agcaaacccctattccatgctgttatgggtgaaactctgggagattctcctattgacccagaaagcgattccttcactgatacactgtctgcaaacatatcacaagtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggattgaaaaatcggcggttaagtgtcttttaaggtcatttccaacaaaactacaaaggacctatgaaaggcttttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 164605 - DNA, 2029 bp, Homo sapiens
  Payload ID: 12428
  Gene Symbol: PPARG
  Gene Name: peroxisome proliferator-activated receptor gamma
  ENST ID: ENST00000397026
  CDS Start-End: 384-1835
ccttaacctctgctggtgaccagaagcctgcatttctgcattctgcttaattccctttccttagatttgaaagaagccaacactaaaccacaaatatacaacaaggccattttctcaaacgagagtcagcctttaacgtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggattgaaaaatcggcggttaagtgtcttttaaggtcatttccaacaaaactacaaaggacctatgaaaggcttttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatatta

SEQ ID NO: 164606 - DNA, 686 bp, Homo sapiens
  Payload ID: 12428
  Gene Symbol: PPARG
  Gene Name: peroxisome proliferator-activated receptor gamma
  ENST ID: ENST00000397029
  CDS Start-End: 291-686
tctgaaagtgtgcagcaccaccgatcagaagagaaaaccaagggacccgaaatatgctttaattaaattttcttttaaaatgtcactggaaagaacatcttgggaagacggcctggccgatcgccgtgtgaagggcaagccactctggccgagagggagccccacacctcggtctccccagaccggccctggccgggggcatccccctaaacttcggatccctcctcggaaatgggaccctctctgggccgcctcccagcggtggtggcgaggagcaaacgacaccagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaag

SEQ ID NO: 164607 - DNA, 560 bp, Homo sapiens
  Payload ID: 12428
  Gene Symbol: PPARG
  Gene Name: peroxisome proliferator-activated receptor gamma
  ENST ID: ENST00000438682
  CDS Start-End: 264-560
ttagtatacaatgaatttataaatgtaaccatacaatttcatgcttagagaacgttttctctccattctctctacctttagaccattctgcagtttaaatcttgaaccaaaatgtcatttaaccatccttctgaacgataactccataattaactcaagcaccaaataagtcatctagctcttgatgatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcat

SEQ ID NO: 164608 - DNA, 428 bp, Homo sapiens
  Payload ID: 12428
  Gene Symbol: PPARG
  Gene Name: peroxisome proliferator-activated receptor gamma
  ENST ID: ENST00000455517
  CDS Start-End: 300-428
ctttgtgggctcctgcaagtgccaggcgctgaccactcctcctgggagcctaactgaggggggtagaggcagcagaggttaacagaaatctcaggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagaaatgaccatggttgacacagagatgccattctggcccaccaactttgggatcagctccgtggatctctccgtaatggaagaccactcccactcctttgatatcaagcccttcactactgttgacttctcc

SEQ ID NO: 164609 - DNA, 6318 bp, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENST ID: ENST00000264867
  CDS Start-End: 121-2517
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatcta

SEQ ID NO: 164610 - DNA, 1432 bp, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENST ID: ENST00000513205
  CDS Start-End: 79-984
gttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggtgtaaaaactaatttgatttcaaaatagctgttagtaaagcaagatgagagaaaagagaatgctcttttggcagaaggcatttaaatctattgcatatggagattttcagagtgctacacttttttgtttctgaaatgggaatggcaaagcaatgtcagctcaacaaggtgacggtttaaaccacagacacgaaggaatttgggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgacc

SEQ ID NO: 164611 - DNA, 2627 bp, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENST ID: ENST00000506055
  CDS Start-End: 76-891
gcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatttgtttttataaatgtgccatatcttccagtgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaa

SEQ ID NO: 164612 - DNA, 2385 bp, Homo sapiens
  Payload ID: 12429
  Gene Symbol: PPARGC1A
  Gene Name: peroxisome proliferator-activated receptor gamma, coactivator 1 alpha
  ENST ID: ENST00000507380
  CDS Start-End: 79-378
gttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgaggtaaggacatcctttggaaacattaatttttcattgagtttggcttgggcccgactaacatggtaatagacctgaatgcataatgagttcttactttgctatcatcaaaagacttttcatcacagttacatactttctaatttatggaaaaacagcatttggaaaacaaatgttttgtttttatttttttaaagatttaaaaaataaatcaactagggactaggaatcaacaactgtgagtgagttaaactgtgttgaaatactaaagggttgtgaaagattagtgacaaagaagaacaaaagtctaaacctgtttattcctgtctatttcccacagaaagaatgagcaataaatggtacctcatataaattaataaataagaaggcctttctttttaaccaagggggtagatgtctacctttgtttgctttactaattaggtgagctcttttgattattattattaattatatttttggttcatatctctaatttctttatataatgggaattgctaaacttgactaatctactgtatacttataaatcagtcaaaattcatttacttttcagtagcaagaattacctccgtgactccggactcttattataagcctaccctataataaagaatgttaatctattcctattaaagtgttactttgagaaaaggaattctttcccacaagatcagtactcatttacttgaaatacattattttttataggaacaaacatttagtgagtactctggcaagtgaattaaacgaaggatgacatatcggctagttttctttatcacaaccgccagtgccatcatcatcatcatctaatgttttctgagcacctactatgtgctggacttttcttattcatcagcaaagacatttcttatacttccatgttatttggttgaaatctgagtcttaagaaagccaagtttaaaatattaactgagttttgctggaacccagcatataatacatgctgaataaatgtttgttaaatcatgagagaatgatgaatatattaatgttgataacaataatagtaatgacaataatggccaacattttggtatactcatgcttaatatatgtcatctcacttatccttgaaaacaacctattgttaggtcctattgttatcattcctgttttacatatgcagacactgaaactcagagaggttatttgttttccccaaatcacacagttgacaataaagacctgggatttgaaccccaaatttatcggacttcaaagtttatatccttgataaaaatagagaacccatgaatttgggtgacagccatcctttacaaagacatatcaagctgcttctttgctcaatatatttaaaaatagaacagaatctttcctttcagtgttggttggcacggaggtagagttagctggtgagccgagacggctgtaggttctgcctatggctgagattttgtaatacctctggagattaagtgggttttagaagaatgcttaaggtagtagagtttggactggggagacagaacaaggtggagggaacactgaaggttgtggttagttctactttcccaggcttctcagccgggtcttagaaagttcatgtgaggacttggccagttagaactggtaaattgaacattcctcactcagtacacttgtcaagttacaggcccattctaagtcatgctgcattaaataaacaatgctttaaaaaatgtccatctccatagacctcttatctaaaaatcacctatttcatatcaggtgaatgccatgcattttgtagaggctagagaataacttagcggtaggggagatggcataggagtcaatgcctctctggtgggctactttaaaaaaaatacaactttctccataacttttatgtccctatattttgtgttgtggtatttgtgagaggtactttgcatttataccttcaggagacttggttcagcatctagttaattatctacatgtaggtgcttaatatatgccatgccaccctttttgtctccctgtatcatattctatgctaataaaattattttcagcactctaaaa

SEQ ID NO: 164613 - DNA, 1026 bp, Homo sapiens
  Payload ID: 12429
  Gene Symbol: PPARGC1A
  Gene Name: peroxisome proliferator-activated receptor gamma, coactivator 1 alpha
  ENST ID: ENST00000617484
  CDS Start-End: 133-1026
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggtgtaaaaactaatttgatttcaaaatag

SEQ ID NO: 164614 - DNA, 936 bp, Homo sapiens
  Payload ID: 12429
  Gene Symbol: PPARGC1A
  Gene Name: peroxisome proliferator-activated receptor gamma, coactivator 1 alpha
  ENST ID: ENST00000612355
  CDS Start-End: 133-936
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatttgtttttataa

SEQ ID NO: 164615 - DNA, 3210 bp, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENST ID: ENST00000613098
  CDS Start-End: 712-2727
agaagccactttaaaaaacaaagcaaaaggctcagaggtaacagcctccagtgaatctgatccatgtgtaaggaaaacaggatgcgtccctggaccggctggtagcaagatttatgtttcagaatattgcaacataacttccttccctctgttgcctttgtgcattgtttgaaggaggagaataaaggactacttttgcagcacagcagtctgtaaagatggatggcatggggttagtttaaatagcatattggcctttctgggtcactgtgggcaaccttgtccctggtttattttaacacctgctttaatgcctccatgatacaactgaatgggcatctttcattcattcgtctgttacttctgaatgaagctacttggggttcgttagaatgatggcaagtgagaatgcagtcgtctctaggtcattacttgtaatacgttctgaggactgcctttgctgatggggggagaaggactctcacagctgtagccagcgttcatgtttggtcattgctggaactctcaggaagcctgaaactgtgaactttgtagcagaaaaggaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattc

SEQ ID NO: 164616 - DNA, 10568 bp, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENST ID: ENST00000309241
  CDS Start-End: 33-3104
actccgccgcacgctgcagccgcggctggaagatggcggggaacgactgcggcgcgctgctggacgaagagctctcctccttcttcctcaactatctcgctgacacgcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactgctgcagaagctcctcctggccacatcctacccaacatcaagctctgacacccagaaggaagggaccgcctggcgccaggcaggcctcagatctaaaagtcaacggccttgtgttaaggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtcctttaaaaaaaaaaaaaatcaatgtttacattgaacaaagctgcttctgtctgtgagtttccatggtgttgacgttccactgccacattagtgtcctcgcttccaacgggttgtcccgggtgcacctcgaagtgccgggtccgtcacccatcgccccttccttcccgactgacttcctctcgtagacttgcagctgtgttcaccataacatttcttgtctgtagtgtgtgatgatgaaattgttacttgtgaatagaatcaggactataaacttcatttttaattgaaaaaaaaagtatatccttaaaataatgtatttatggctcagatgtactgtgcctgggattattgtattgcttccttgattttttaactatgcactgtcatgaggtgtttgccactgagctgccctgctccccttgccagattgccctggaggtgctgggtggccgctaggctggtctgcaggaaagcgcggcctgccgtttccgggccgtatctgccaagccctgccttgtctcttactgagcaagtttggctcaaattataggagcccccatcttgtgcccagctcatgctccaagtgtgtgtctatccatttgtactcagactcttgagtaccttgtaaggaaggcggggcaagctgcatcattcctgttttccaggggaggctggcagctcctcaagaggcgaaatgactgtgggaggtccggttaccagtgaggaggcagagcggtgacccagaccaggccttctggttcttggtcccgtgcttccgtagtagctggggtaaagacaccgtttcagggactggtagaggtgagttcggctaaattgggcaccgggctagaagcctaagggctcattttaggggttacattaggtgttgattcaccagcatcaggtgaattcaagccctggcatgtgtcttggatgcaccatcagctttgatcctgagtggtcctgcggtttgtctgtgcctgtggacacactgtcagaacttcagtgacacccctggcagcggtacagacaggtggtctgggagcagtcatcttttttgggccagccaccagcccatcctactccctcaggtagtccttcgtctttaccttgtccttgtctgtaaagttgttttggtggctggggcaggggagccaggaggagggagtgaaggttgggaatagataggacaatctcctagctctcctccaattgagaaaacactccaattgggctttgctttaaactttgtgttcttaagtgatgtcaaagccatttccagcttaatgttctgtgggtaccttgggggccattcatgcagggagcatggccaggcagggtatgagtacattgtttctgatttctttcatacatcagggttcctcgggaaatttttgtattttttttttaagtcctgctgctttaaaaatttgaaagtggctcattaaactaaacaggctaatgtaatttgttgcttatgccaagcctagactgttgagaattgacgtttttaaagattatcaaatacctcagtaggtaaaatgagcccatgatcttccactgagtggtgagcatactcccagcccatggacaaggccggaagagacaggctttagtaggggtagggaatttgaactgttgtgtgtcacagcagttgacctctctggactccaatttcctttcctgtgaaatgaactgattagacatgtttcaacattgttagcttctgctgaggcagtgtctagcccaagatggcaaatacatagctcatgtgccactactcccacctccttgaccaatacagacataactaatcaatcacaccactcaggttccctgagcctggatgtgctataagaatcctgaaatcagtgctctggtaagtcattactaattgattagagttcaatctatttgacatcttgggctaatctttggaaggtttccaacaatcacacaaaaccatatgctggctgggtttcatgctggcctatccctgtctgtgatgttccgttccatgagagaaaactcccctaatgctattccatggcgtaacactcccaatactattttgacgcccacgtccccttgcagagggtgcagggggcggtagacgaatgacagacaggaacatatttggggaaggcagggcttaggaagatggaccaaaaagggacttcccacagcacagacctgatcattcggatttcctctttagctattcactgcctagcacatagtaggcacacaataaatgattatggaatgggataaaatttagatctttctgctgcctccactaagttaagtcctgatttacatcaaggagagaactgagataggaaagaacactagattccaagtctggagagttgggggagtccagattctaccaagaatttcctttgtaactttggtaagtcccttttactccctggcaccccggtgtgctgaaaggagttggtccatatatgatctcttagcccctcctatttgcttcttccttgattgctcttggtcaaagggtcagccttgggctggtgatactttagagtaaagaaatggagagttttagcaaaggaccagtctgtccctccctgctttggggtcagctaaagctgtcctttcatgtcagattaacctaggacacttgtagttagcttagacgttggcccttgagcagagacctgagcgtggcattgggacatgacatacctaaagtcagggctaggggacgctgcctgccaagggcatcgagtagtctctacttgctatcccgtacataaaatgctacaagttctaaaatttaccgaccctgcagacaacctctatcccgaaggactcattcggtgctgtgtattatttagggcaactccaaggtctattcagaaaaacgagtgaaccttggtctctttcccaccaaattgaggagtaacccagagggagcagctgccattggcaaccatctcgttgtagctctgtcctagtgtttgctcttgatgatgtttacatgtgatcgccataaagcttgctgtagactgtgtcgatagccgcccgcacagggcaggtcgtactgtccgtttctgtgccgtgctggtgttttccaaaaatgtctgatccaaccactaagtggaattcttccatctccttcctcagtctgtacaaggctgaatcagaatccccattctcgggggctctggttaccgaaggaaaatgcatcaaagagttaaagaatatgagtggatggagtgcagctaaggcccccaccccctgctccgtcacaacttgccccctcaaccaaaaagctgctttgagtcaaaaagcacccataagatacctgcatctgccttgaaatcttgcagcatggagtgtcatatgtactcaggagagaggcagggctttgcgggcaggagaaggaagggaggaatgctctgagctgcaaagacccagtactcaagttctgacgtgggaggagatgcagtgagacgtctcttgttgcctaaagcctgttcctgttggttttcttagagtgatttctcctagacatgtgcagtaggcccactggggctgctgtgcagtggtgagtaaaagggcagggaaggcatggacagcctggtccttctgcatggacagctcagtccatggcccatcccaggtatagagttcagttaatcccatttgagcctgcagcttaagagatggctcatcctaactgtgaagcaaaatcagccccagaggatgtattgatctgactcactgatgtcaaaattgcagtatttttttagcatttgagatttagcagctgccttcagtttggggttacccacatcccagcatcagatatgattaaggaaagaaattggatgtacaacagcaaagaaagtgaatgtcatggtttccctggccaaagaagagggaccctgtcatccttaccaatggggaagaagaaaactagtgcatgtgcaatatgtcaaagttagtcccctagtccctgaggggtttttacacacagatgggctccaggtctgctcgtcaagtttggaggtaccgggtaaatggaggggagctgcagagttggaaacccacatgcatggatgtgtccttggcccagaaccaccatgggatgggggaggccctgagccggctacaagacacccaggaagtaggcaaaggctgactttgcattaaacaataaaagcactttgagaaaaccccaacacttcagcctgggtccgtgtttctacactggaaaatacgagtctcctttggctgtgtgaagtgatcttctagagactgggacagggagtttgggaatggggctgctgtcaggtaggagagagcagagatgcctttggagatgtcagcagcaggagagccagtgctggggccaaccctttgctggccttttgttggaagcccttgaaacagggagccatgggtttagatcttggtacctacctttacagaaagatgaaaacagcccagctgagtgaaatgagtttgtagagtaagtcacttaactgtaagccatctcagaatcagaaaccctaatgtttcttacttgctatgtgaccttgggcccctgtttcctcatctaccaaatgagaatgttgaatatgagcattaaagtccctttcacctctgagaggctcagatccccaaccaggagcattgggaatccatcactcctccttgaaactgattccattctctgacttgacccagctcctgttcagggtgagggttctctgcaagaaccaaccagcagtaggttcaatcccactgtgtcctggctgagttgccttatccaagaagaccagctccccgggacagatctaagccatagtttctagtggggacagtaaggaattaaacccccaacttggctaggtaacgatgtcaaatctcacattaaccttgtctttgtccccactggatagctgttaatccgaatgttgtgaccatttggctgtttctctcttgttctcagacaatactagcaatacactttttttttttttttttaaagaaaaacagcttaggagcttttcacacatttctttcaaatgattgtaaaacatatggggcaacaggaggcattgatcgcgctgcatatgtttagggcagcttttgttttttgtttctttaatggtatagcagcagtgactgagccttcgtgattcctggggacagcttttcagatactctgtttcatcagtatgctttgcacatccggaaggagtacaaaaatccaactgcccaaatttggggcttggaaaataggttttataggtggtcggtccctgggctgtgcaacaactcctcaaagaggggtttatataactagaacccccctgggctgtatttttggtcaaaggagtctccaaggcggcttacaaaagcttcctttttcacttgaccacccttgctcattggttacttgtgaagggaattggtcagtttccacctcagcactttgccttatcaacatgcggtcgccatctagtggccaaaggttgtctccaccagctacccagatggaaggcaaataaatcctttcggccaccctgctgtccatcgtgaactttgggaatgaaatataatggcctgaacgaactgcctttgtgttcagagatcagtgcaacactagggtcagaagactccagaagcagccacttagtagactctcacgcagaactgagaaatgcactagctgtcctgtgggcagaagagacaggagtggaccaggagaggtccaggtgcccgggaagggtttactgtaactgcaatactggcagcccagctgctgaccttgttaagtaaacctttgctgggtggtccgaattctgccctcaaggcaagataagaagttgggtgtaaggattttgtggggggcctggccatgatctttgatatgatccccgaatagccaaatagttttttttgttcaattttttgtttctgtattttgtatttttaaaatcttgtcaaatgtttttgtgttaggaataaaaagtcataaactattcccaactttgtttcttgagggatgttctgattccaatggaaacaggtgggaaatctcaaggggagcgtggacaaggtggtatgtgcagcaggggaatagactgcttggatttccaaatggtttctggggaagatgaccatccagaagtccagcttagtgcagtctgctctggaattcacacccaccccctcgcctccttgtgccatgttgttagcattggcttggagcatctgcttcttccagaggcagctgctaatgttgaaaccaacacgagccctctccccaaccccaggtttctaaagaaggtgtctgtagccagccttaatcaactgggcaaggtggtccctatggtcctttccagcatttccaaatcttggactcaaattattttctcttggtgtgaccacacagcctagagaattctgagcaataggagccagggctttccctgactctgcgacagggtcaaaccaaggaatggctaaacctgtgaggttttgtcatccccgggggtactactgtagggggcattatttattaggaagcttaacaaggtaactacggcctgagtgcgtgagtgtaaggctgtgtttgtggtgggggtgtgtgtgtgtgtatctgtgcacacatacacacgtctgtgcctgtgtgtgtgtgtttgtgtgtgtgtgtgtgtgtggaattacattgatgcatttattgagaaaggtgcaagaatttcacctacacagagggacacatctgctttgttatttataatagaaagctaaattttaattttttaaaggacactgctaatgattgagaatcaagtttttagttttgctattttttttaattggtagaggatttttatatattttttccattttgttgggttgtgtccttatttatataaatactttatccgtaagaggcaaggaggaaaccttctttgcttttacatattgtggttgtcatcgtccctattttatttctggtgtgatttctctgtcttaccttctaaatgagaaaatgttttcttgtatttgtacattgtcagattctatagtttcctagataatttaaccaaattgctctatgtattattattctgtgagtataaagttctattttaatgtctgtaaatacttcagaactggcttcttttctcaaactcccactgtggggttattgtttacatcacagaaactgtagaatctctatgctcatgtactgtaaatagtgaagtgatctgcttataaataaacttaacaaatacactatggagattaaaaacaaaataccacccaca

SEQ ID NO: 164617 - DNA, 3004 bp, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENST ID: ENST00000360453
  CDS Start-End: 46-3000
cggctcggcgttgactccgccgcacgctgcagccgcggctggaagatggcggggaacgactgcggcgcgctgctggacgaagagctctcctccttcttcctcaactatctcgctgacacgcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataac

SEQ ID NO: 164618 - DNA, 4803 bp, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENST ID: ENST00000394320
  CDS Start-End: 43-3096
ctcggcgttgactccgccgcacgctgcagccgcggctggaagatggcggggaacgactgcggcgcgctgctggacgaagagctctcctccttcttcctcaactatctcgctgacacgcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactgctgcagaagctcctcctggccacatcctacccaacatcaagctctgacacccagaaggaagggaccgcctggcgccaggcaggcctcagatctaaaagtcaacggccttgtgttaaggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacggtaagcccctgaaacccagccacagtctagtaagactcaaagcttgggaagcagtgccttccttgaacaaaacccagagctaaagcgccttgtggacatagcttccatccccacaccccagtgtgctgcttggtataactttgcagccactttgcctgaagactaccatcctgtttctcttctggcctctggtccaccttatcctgtcctgtgactgctaccaaagagaatccagcctcccacggcctctaggaagattcagtcatgtgcacagccagctggcagaaccgtggctacggtctccttgacttcacagggccagctgctaccctgtccccttcaggggcattccgtggtgaccccagacaaggcagcagccacctggggacaagatgatgaagaaggacaaagaagtacaatgtacgaaagaattacttggccaggctcagtggctcatgcctgtaatcccatcaccttgggaggctgaggcaagaggatcacttgagcccaggagttcgagaccagcttgggcaacatagtgaaatcctgtctctacaaaaaatataaaaattagccaggcatggtggcttgcgcctatagtcccagctactcaggaggcagaggtgggaggatcacctgaacccaagaggttggagctgcagtgagccatgatggcactactgcattccagcctgggcaacagagcaagaccctgtctcaaaaggaaagaaaaaaaaaaaaacacttactggagagaatccaatgcagccttgatggtacaggactgagtgtcagtgacccggctgggtgccaggccaggcggccctgcccttggctgcatgtccatttatgggaatcagtttcccaatctattaaaaaattctagtgttggctgggtgcagttgctcacgcctgtaatcccagcactttgggaggccgaggcaggaagatcatgaggtcaagagatcgagaccatcgtggccaacatggtgaaaccccctctctattaaaaatacaaaaattagctgggcgtggtggcgcacacctgtagtcccagcaacttgggaggctgaggcgggagaatcacttgaacccgagaggcagaggttgcagtgagctgagatcacatccctgcactccagccttggtgacagagcgagactgcatctcaaaaaaaaaaaaattctagtgttgttagccctcccttatgtggcactgcagcaggttactaatggacgagaagctgttgggggaagtagagttgtagggtgttggagctagaaaggctctggagtgctctagtttgggcctccaggtctctagataggacagccaaggccctgagacactgataccatggccaagatgtcccagcaggatggcaggcagtgcccacagtccagcgctcatcccagctccccaaggccttgggctgcagccactccacggtgcccactcatagtggcagattcttcaaccatccggtctttgtaagttgctcactgccttcccctcttccctgcctcttcacccccatgcccagattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtccttt

SEQ ID NO: 164619 - DNA, 3146 bp, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENST ID: ENST00000403750
  CDS Start-End: 198-3077
acattctcattttaatcctcaagcaactctgaattagttgctgttatcccagacttacaggcaggaagcaggctcagagaagtgaaggtttccaacttagacgtgccaggctgtgcacaggtggggacctctgaggggcctgctctgatctgggttggggctgccccaggacccttggaggagccgccaccagagcaatgggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttc

SEQ ID NO: 164620 - DNA, 2457 bp, Homo sapiens
  Payload ID: 12430
  Gene Symbol: PPARGC1B
  Gene Name: peroxisome proliferator-activated receptor gamma, coactivator 1 beta
  ENST ID: ENST00000434684
  CDS Start-End: 1-2245
ggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacggatggcaggcagtgcccacagtccagcgctcatcccagctccccaaggccttgggctgcagccactccacggtgcccactcatagtggcagattcttcaaccatccggtctttgtaagttgctcactgccttcccctcttccctgcctcttcacccccatgcccagattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtcctttaaaaaaaaaaaaaa

SEQ ID NO: 164621 - DNA, 5330 bp, Homo sapiens
  Payload ID: 12431
  Gene Symbol: PPRC1
  Gene Name: peroxisome proliferator-activated receptor gamma, coactivator-related 1
  Uniprot ID: Q5VV67
  ENST ID: ENST00000278070
  CDS Start-End: 40-5034
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagaga

SEQ ID NO: 164622 - DNA, 2163 bp, Homo sapiens
  Payload ID: 12431
  Gene Symbol: PPRC1
  Gene Name: peroxisome proliferator-activated receptor gamma, coactivator-related 1
  ENST ID: ENST00000370012
  CDS Start-End: 117-2012
ctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcaga

SEQ ID NO: 164623 - DNA, 4580 bp, Homo sapiens
  Payload ID: 12431
  Gene Symbol: PPRC1
  Gene Name: peroxisome proliferator-activated receptor gamma, coactivator-related 1
  ENST ID: ENST00000413464
  CDS Start-End: 76-4278
gtagttcctttcccacaatcggctgggcgaggcggcgccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcagggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaactccc

SEQ ID NO: 164624 - DNA, 4290 bp, Homo sapiens
  Payload ID: 12432
  Gene Symbol: PERP
  Gene Name: PERP, TP53 apoptosis effector
  Uniprot ID: Q96FX8
  ENST ID: ENST00000421351
  CDS Start-End: 172-753
ggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaacttgtttccagtttgtagtttttccatttttcaaatctggggaaaggaattaaaaaaaaaatgggtaataagaacatgggatataatgaaaagtggtttttgtttgtttttttgtttgaagttttaagggccttgctcattttaggtgtccaaaaccaatttttgagtggagattaatgaattctaatagtctattccctgaacttttcctcaatgaacaataccctagacacacattaaacaatttctctgcagtgctatcaaccagaggaaaatggactaagagatttctggcaggttcagacacccgggggacatgtgtgcagtgtagctgaagcctcctccttgtgctggggtccccttccattcaggtggtggggtagcagtctctctattttccccttgccctccttcccattttatcatttgttattttttttcccaccataagtcatatgttacttccactatggtgtatgtcattgtgaggatgggtgcagagaggctgggtgggagaacggaaatatatctccctagggctactgttggccagctagtccttggcagtgaatttttctatgcttttcaaaatgcgaggtgaatgtttctcatagagaaatgtaatctgggtgattataccaaaattgaaaagaaaaacccacacaactatgccgtggctggtggagaatttgaagtggtcattaaaaatgttaaaaatcccatcttttaaagtgataccacagctcattcaagaagatactggatatctagagattaagaaacgtggtctcctgttaaacatgaaaatgactccgtttataagcttctctaccacatgcacttgtctttgcatgatttcccatccagccttcttcccctcctcaatcacacaataccttaacggcgcacatttaggaaaaatgcaacctcctgggaccaacgagcctgatataatagaaccatgtcaacctaaagtatttatgacaaagataaactcttattttgcagaaatggtctgcttccttcagccttgttctagtatagagatctgccattccttgttgatccagattcaccaagacagatacctttatgtcataacagaagggaagttccagaggattctggagagtaatgaagaattgggctgagaaaccacctgaaggctaacagtgcattgcatgagatttcccacagtaaagctgaggtgctttttggttcagtaattaaatattgagttcccaccctttaaataagcagttctaggttcctaagcaattatttcactctgtaagtagccagacatgctaagtggcacttactgctgattgtaacaaagaagtaatatatcaaggtctttccatgttcacacaaggtagcttgtgtgtaataacttagcttcaaaaccatagactgcagaactcacaagttcaacagcctttccttttttaaggaaatgaaaacaatggaaaatatagtcatcataacttaattcggtttattttttttttctgtaaactccccctgaaagacattcctattaatacagtaaatgtgaacactgacttgtttttataagcacatctgaaagggcatatttgagtctcatcccaactttggtccttgctatctgtgcaggcttgggcaggtcatctccctgctggtctcaatatcctcacctgtaaaatgattgtaaatgatccccctaccttcaagattctctgattgatagaattttttctttaattaaaaaattttaaatattccttgagttggaagcactgatcaataagtggattgcttagggaggttggaacgaatagattcagtcccaacttcctcttttaaattccctcttcctcactcttcctgcaacacttatttttacagttgagttttaaaaataagtaatatataaaataatttctgtagtgtggtttcagatttaaaaattcctgcagacaggctgggcttgcaaccccatcagtcgatggtcagagccctttgctttttgagaccatttttaggtgagcttggcttgcctggatacagtgtgcagtgcattcttcctgaattttgcaattctggtatctgggtgtattttctaggtgtgtcagggtgagtgtaatccacctagggtgtggaaaaagccaagaaagggaaattaaaagaggttcctatccagtcatgttaatgatcttccacttgtactatcctgtgcttcgttgttaacctcgaaaacatactttgttggctgcaaaaataaacaaagggaaactca

SEQ ID NO: 164625 - DNA, 471 bp, Homo sapiens
  Payload ID: 12433
  Gene Symbol: PSPN
  Gene Name: persephin
  Uniprot ID: O60542
  ENST ID: ENST00000245810
  CDS Start-End: 1-471
atggccgtagggaagttcctgctgggctccctgctgctcctgtccctgcagctgggacagggctggggccccgatgcccgtggggttcccgtggccgatggagagttctcgtctgaacaggtggcaaaggctggagggacctggctgggcacccaccgcccccttgcccgcctgcgccgagccctgtctggtccatgccagctgtggagcctgaccctgtccgtggcagagctaggcctgggctacgcctcagaggagaaggtcatcttccgctactgcgccggcagctgcccccgtggtgcccgcacccagcatggcctggcgctggcccggctgcagggccagggccgagcccacggcgggccctgctgccggcccactcgctacaccgacgtggccttcctcgatgaccgccaccgctggcagcggctgccccagctctcggcggctgcctgcggctgtggtggctga

SEQ ID NO: 164626 - DNA, 3911 bp, Homo sapiens
  Payload ID: 12433
  Gene Symbol: PSPN
  Gene Name: persephin
  ENST ID: ENST00000597721
  CDS Start-End: 3210-3704
cagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgcctgcagccactacttttgaacccatcttccgggcaatcccttctgtcttgccggtggttggaaacttgcaggtggaagtcttccccacccagttctgcagcccttggctgccgagcaggaatgcctgagatgtctggctaattcctcggaatgtcccagttcaggccaacctccctcccccttctcccaccaggccttcttgggcagcagggaggcagctctggagggagccgctgcctcagcagtttcgccccagccacccccactgcctgggccttcatgtaaggaggctgggtggtgaggccctgtggtgaggagcaggggttttgcattcacggaggacctgggttcaaataccaggaccgttgcttaattctgggtgacttcaggcttttttttttttttttttgagatggggtctcgctctgtcgcccaggctggagtgcagtgacatgatctccgctcactgcagcctccgcctcctgggttcaagcaattctacctcagtctcctgagtagctgggatgacaggcacgccccaccacggtccagctaatttgttttttgggtttctgagacggagtttcatgctgctgcccaggctggagtgcagtggtgcaatcttggctcactgcagcctctgcctcctgggttccaagcgattctcctgcctcagcctcccgagtagctgggactacacccagctaattttttaatagagacggagtttcaccatgttgaccaggctggtcttgaactgacctcaggtgatctgcccacctcggcctcccaaagtgctgggattacaggcgtgagccactgtgcctcgcctaatttttgtattttcgttagagacagggattcaccatgttggcctggctggtctcaaactcccgacctcaagtgatcctcccacctcaccctcccaaagtgctgggattataggcatgagccactgggccccgccaggcttttttgagacagtatcgctctgtcgcccaggtttgagtgcaatggcacaatctcagctcactgcaacctccacctctcaggttcaagcaattctcctgcctcagcctcccgagtagctgggattacaggcgcccaccaccatgcccagctaatttttgtatttttaatagagatggatttcaccatgttggtcaagctggtctcaaactcctgacctcaggtaatccacccgcctcagcctcccgaggcatgagccaccacgccaagcccaggcttttctttccatcggaaaattatcatctcaataagcacttcagtaagaaaaaccacaacataatcatcgaagcaatccctcacggatggagttgaggccacttccagactttcctaatatgaagaaggcatcagatgtccctgtgctggctgtttcacttgcctgtgtgggaggaaccccgcaaacagggctcctggggcagagggtgtaatttacaattccccagtagcagctgctcatccaaagagctgctagcaatttacacccccaccaacagcacagggtgcacctgggtcacacgggttgtgtgtgagggttttctgattttccccaatcttgtgggtgcttagagtcaagcaccccttcggacaatcacaagctgtttgcttgtttttgcattcgaagctacgggcactgccttacactctaagtgcccatctctttcctcaccaagccgagtaggaggggttctgaggagctcccctgtaccggtgaggggactgggctcacacggggctgggtatggaagcctcgagagcccttatctgtctgcatcgtgctagacgttaccatgacctggacagcctccatcgccccgggggctctgacatgctcagatcccaggatggggctgcagttataggggtctcaggttggccttcccgagacaggcgtccctgtccccttgtgtccccacccttggctgtccccaggcctctcccttttcctgttttgatgctggctcagccaggcccggagacaggggcatgatgtcctaatcctccaggcgggagccaccatggagggttcccgtggactcagtcccctgccaagccacctttcccagcactcacatatgctccacctggcacatgatacacgtgggggctcctgagccccagcaccctgacttagtggggagggaccccaccggggtcccatgaagccccctgacttccactccaggcagcaggtcgggggaacaccagttgcctgccctggccgccagcacagcactcgtaaatcagggggtgtctggggcgtcggaaatggctgtgtggaatgtcggggtggggtaggctgggggtgagcccttaactcttagaagggtggggtgtggggcagaaggagcagatgcctggattcgagggtgcaggagatgggctggtgcagacgtggggcctcctggctgcaggggccggcagtgaagaggttagctcccagcccaggcagggcataaatttggggcacagctcccactctcaggacctgcccgtcacaatggccgtagggaagttcctgctgggctccctgctgctcctgtccctgcagctgggacagggctggggccccgatgcccgtggggttcccgtggccgatggagagttctcgtctgaacaggtggcaaaggctggagggacctggctgggtaaggacttccagggaccctctgtgacttcccaactttccccagccctgaccctgctcactgtcagcgcccttccctcccacaggcacccaccgcccccttgcccgcctgcgccgagccctgtctggtccatgccagctgtggagcctgaccctgtccgtggcagagctaggcctgggctacgcctcagaggagaaggtcatcttccgctactgcgccggcagctgcccccgtggtgcccgcacccagcatggcctggcgctggcccggctgcagggccagggccgagcccacggcgggccctgctgccggcccactcgctacaccgacgtggccttcctcgatgaccgccaccgctggcagcggctgccccagctctcggcggctgcctgcggctgtggtggctgagggtgcccggcctggcacccagaagctgcagtgctgggggagctcggctgacttatttattggagacctggatgcagagacaacgaggaggggagtgggctggggcgaccagcagtgagtgcaataaaggacaccactctcccggc

SEQ ID NO: 164627 - DNA, 1988 bp, Homo sapiens
  Payload ID: 12434
  Gene Symbol: PES1
  Gene Name: pescadillo ribosomal biogenesis factor 1
  Uniprot ID: O00541
  ENST ID: ENST00000335214
  CDS Start-End: 26-1777
ctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagag

SEQ ID NO: 164628 - DNA, 2295 bp, Homo sapiens
  Payload ID: 12434
  Gene Symbol: PES1
  Gene Name: pescadillo ribosomal biogenesis factor 1
  Uniprot ID: O00541
  ENST ID: ENST00000354694
  CDS Start-End: 108-1874
agacagcgtggggtggggagggtcctcggggtccttggcagggcacgtgcgggaggaagtggagctccctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 164629 - DNA, 2144 bp, Homo sapiens
  Payload ID: 12434
  Gene Symbol: PES1
  Gene Name: pescadillo ribosomal biogenesis factor 1
  ENST ID: ENST00000402284
  CDS Start-End: 48-1763
ggagctccctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgagcacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtaggggga

SEQ ID NO: 164630 - DNA, 2760 bp, Homo sapiens
  Payload ID: 12434
  Gene Symbol: PES1
  Gene Name: pescadillo ribosomal biogenesis factor 1
  ENST ID: ENST00000402281
  CDS Start-End: 993-2342
agggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctgccgcataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcaggtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaatt

SEQ ID NO: 164631 - DNA, 871 bp, Homo sapiens
  Payload ID: 12434
  Gene Symbol: PES1
  Gene Name: pescadillo ribosomal biogenesis factor 1
  ENST ID: ENST00000406208
  CDS Start-End: 467-871
gcgcggccctagtcggctcctcaacgtggagcgatgggaggccttgagaagaagaaggtgattgggaaagacgtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggag

SEQ ID NO: 164632 - DNA, 2708 bp, Homo sapiens
  Payload ID: 12434
  Gene Symbol: PES1
  Gene Name: pescadillo ribosomal biogenesis factor 1
  ENST ID: ENST00000405677
  CDS Start-End: 945-2294
gcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctggtgagaagcagcagcatccttccagagagtcacttctgatccccaagccgcataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcaggtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgcc

SEQ ID NO: 164633 - DNA, 999 bp, Homo sapiens
  Payload ID: 12434
  Gene Symbol: PES1
  Gene Name: pescadillo ribosomal biogenesis factor 1
  ENST ID: ENST00000441668
  CDS Start-End: 1-583
gccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaa

SEQ ID NO: 164634 - DNA, 2342 bp, Homo sapiens
  Payload ID: 12435
  Gene Symbol: PCNP
  Gene Name: PEST proteolytic signal containing nuclear protein
  Uniprot ID: Q8WW12
  ENST ID: ENST00000265260
  CDS Start-End: 122-658
ttttcattcctcgggaccgctctaggctgccaccacgccggctggccccaaaaactcgatggttgttgggcggggtcgtgacgtccttggcgtggctgcaggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagtacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 164635 - DNA, 786 bp, Homo sapiens
  Payload ID: 12435
  Gene Symbol: PCNP
  Gene Name: PEST proteolytic signal containing nuclear protein
  ENST ID: ENST00000498274
  CDS Start-End: 31-153
gtggctgcaggggaggccgcggcggggaaaatggcggacgggaaggcgggagacgagaagcctgaaaagtcgcagcgagctggagccgccggagttaattcatgggagcctcttctactgccacacaatctcagttcctgctgtatactctaacaaacagtggaagagactgttgggtcagtaggtgacaactgcagaggtatcttccttataacgatgctttttgaggttgctgctcccatcaatctgctcagtaaaaatagctcatcttggtaagttgtttcgacttcaccaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattgg

SEQ ID NO: 164636 - DNA, 2165 bp, Homo sapiens
  Payload ID: 12435
  Gene Symbol: PCNP
  Gene Name: PEST proteolytic signal containing nuclear protein
  ENST ID: ENST00000460231
  CDS Start-End: 27-200
ctgcaggggaggccgcggcggggaaaatggcggacgggaaggcgggagacgagaagcctgaaaagtcgcagcgagctggagccgccggagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagtacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtcttta

SEQ ID NO: 164637 - DNA, 2028 bp, Homo sapiens
  Payload ID: 12435
  Gene Symbol: PCNP
  Gene Name: PEST proteolytic signal containing nuclear protein
  Uniprot ID: Q8WW12
  ENST ID: ENST00000469941
  CDS Start-End: 177-344
aggggaggccgcggcggggaaaatggcggacgggaaggcgggagacgagaagcctgaaaagtcgcagcgagctggagccgccggagaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagtacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 164638 - DNA, 136 bp, Homo sapiens
  Payload ID: 12435
  Gene Symbol: PCNP
  Gene Name: PEST proteolytic signal containing nuclear protein
  ENST ID: ENST00000627393
  CDS Start-End: 14-136
cgcggcggggaaaatggcggacgggaaggcgggagacgagaagcctgaaaagtcgcagcgagctggagccgccggagttaattcatgggagcctcttctactgccacacaatctcagttcctgctgtatactctaa

SEQ ID NO: 164639 - DNA, 219 bp, Homo sapiens
  Payload ID: 12436
  Gene Symbol: PET100
  Gene Name: PET100 homolog
  ENST ID: ENST00000456958
  CDS Start-End: 21-155
tgttgaccgggagaaacgagatgggggtgaagctggagatatttcggagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgtta

SEQ ID NO: 164640 - DNA, 375 bp, Homo sapiens
  Payload ID: 12436
  Gene Symbol: PET100
  Gene Name: PET100 homolog
  ENST ID: ENST00000598540
  CDS Start-End: 1-139
ggtgaagctggagatatttcggatgataatctacctcactttccctgtggctatgttctgggtttccaatcaggccgagtggtttgaggacgatgtcatacagcgcaagagggagctgtggccacctgagaagccatgagtaaggaaccgagagcagaggagtagatggtttccttattgccttctcctggaagagtgaagcggatcccacgcggacccctttcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattca

SEQ ID NO: 164641 - DNA, 719 bp, Homo sapiens
  Payload ID: 12436
  Gene Symbol: PET100
  Gene Name: PET100 homolog
  Uniprot ID: P0DJ07
  ENST ID: ENST00000594797
  CDS Start-End: 98-319
agcttcagcaatggagcgtgcaaaacaccagtgagcttctgtcttgctggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattcatttaagtgttttattcttttatcagtttttgggggccgagtgagacccaggatgcctcaggccctcagggggcttgtgtcgggggctgggggctgctgttccgacggaagccgagagcggtcgggtcctgaggggtgagcaggggttggggactgagggtcccagctcgtttctgtgctccgtcctgtggatgaagaggggtcagccagggggagggctcaagggcagtgccggccacaggtggcgaacaatggagagagggtgcaggtagccaccgtgtcccacctcattgtgagcactggtctatgtttaccctcaatatctgccattta

SEQ ID NO: 164642 - DNA, 332 bp, Homo sapiens
  Payload ID: 12436
  Gene Symbol: PET100
  Gene Name: PET100 homolog
  ENST ID: ENST00000601406
  CDS Start-End: 11-217
gagaaacgagatgggggtgaagctggagatatttcggatgataatctacctcactttccctgtggctatgttctgggtttccaatcaggccgagtggtttgaggacgatgtcatacagcgcaagagggagctgtggccacctgagaaggtaagtgatctcttcttcctgccagagggatggaggaggctggattcttgtatccgggatgggttttagatgaaaattttaggccaggcgcagtggctcatgcttgtaatcccagggcatgggaggctgaggtgggtagatcacttgaggtcaggagttcaaaaccagcctggccaacatggcg

SEQ ID NO: 164643 - DNA, 1141 bp, Homo sapiens
  Payload ID: 12437
  Gene Symbol: PET117
  Gene Name: PET117 homolog
  Uniprot ID: Q6UWS5
  ENST ID: ENST00000432901
  CDS Start-End: 84-329
agtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtaaggagcttctcaattcctttgatttgtcaattcctgtgtgaaggtttgtttttccaacctgtgaaagaaacgtgaatgtaaaagagacctaaataaaaggataattatatttattctctagttgatcagctataaatttatataaaacataggcatgtttgtactaatgaaacgtactgtcaacctctatcacattgttaaattaacacttttggtggtaactcaataaaattgagaaaattggaaa

SEQ ID NO: 164644 - DNA, 1657 bp, Homo sapiens
  Payload ID: 12438
  Gene Symbol: PPAN
  Gene Name: peter pan homolog (Drosophila)
  Uniprot ID: Q9NQ55
  ENST ID: ENST00000253107
  CDS Start-End: 107-1528
gcccgcctgatgtcgtcccacgccgtgccggctctcaggcgccggaagtgagctgcgcagcgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggc

SEQ ID NO: 164645 - DNA, 1575 bp, Homo sapiens
  Payload ID: 12438
  Gene Symbol: PPAN
  Gene Name: peter pan homolog (Drosophila)
  ENST ID: ENST00000393793
  CDS Start-End: 224-1486
cccggcagcttgggaggcaggtggcgcaggtggggtcccggccgaggtcgcggcgctgaccctttgtctctcgtcgccgcagtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttg

SEQ ID NO: 164646 - DNA, 844 bp, Homo sapiens
  Payload ID: 12438
  Gene Symbol: PPAN
  Gene Name: peter pan homolog (Drosophila)
  ENST ID: ENST00000446223
  CDS Start-End: 214-844
gtcatggagccgctcactgccagccgtctgcagggcttttgctgggctggagtgagggcgcgcagcttgggagatagatagtcgcctaagcctgacagttaagactggaatctggagccgggcgtggtggctcatgcctgtattcccagcatttggggatgctgatgcgggaggatcacttgagcccaggaattcgagaccagcctgagcagcatggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctca

SEQ ID NO: 164647 - DNA, 757 bp, Homo sapiens
  Payload ID: 12438
  Gene Symbol: PPAN
  Gene Name: peter pan homolog (Drosophila)
  ENST ID: ENST00000444703
  CDS Start-End: 1-626
aggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggcca

SEQ ID NO: 164648 - DNA, 594 bp, Homo sapiens
  Payload ID: 12438
  Gene Symbol: PPAN
  Gene Name: peter pan homolog (Drosophila)
  ENST ID: ENST00000430370
  CDS Start-End: 304-594
acccaccctcggcctagtcttcgtagctgcagtaatggctcccgctgtaaaactgtgggaggacttaagtctccccagctggaaaaaaagaccctcatggggagcatcatttctgcctttcagggcttttgctgggctggagtgagggcgcgcagcttgggagatagatagtcgcctaagcctgacagttaagactggaatctggagccgggcgtggtggctcatgcctgtattcccagcatttggggatgctgatgcgggaggatcacttgagcccaggaattcgagaccagcctgagcagcatggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatg

SEQ ID NO: 164649 - DNA, 1182 bp, Homo sapiens
  Payload ID: 12439
  Gene Symbol: PGAM5
  Gene Name: PGAM family member 5, serine/threonine protein phosphatase, mitochondrial
  Uniprot ID: Q96HS1
  ENST ID: ENST00000317555
  CDS Start-End: 59-826
tcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagcatcccgccgctgttgtccgctggggattttgtgcttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaa

SEQ ID NO: 164650 - DNA, 1084 bp, Homo sapiens
  Payload ID: 12439
  Gene Symbol: PGAM5
  Gene Name: PGAM family member 5, serine/threonine protein phosphatase, mitochondrial
  ENST ID: ENST00000454808
  CDS Start-End: 362-784
catgctcttcccaaatagtctgacaatttggaaataacatcttgtcagaaaaactcaaacttgggaacagaggtctcaaggacatatcttgtatttcaacatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccac

SEQ ID NO: 164651 - DNA, 2834 bp, Homo sapiens
  Payload ID: 12439
  Gene Symbol: PGAM5
  Gene Name: PGAM family member 5, serine/threonine protein phosphatase, mitochondrial
  Uniprot ID: Q96HS1
  ENST ID: ENST00000498926
  CDS Start-End: 59-928
tcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacagtggctcacacctgtattcccagctactcaggaggccagggtgggaggatcacttgagctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttgcccaggctggagtgcagtggtgcgatctcggctcaccgcaacctctgcctcctgggttcaagtgattctcctgcctcagctcccgagtagctgggattacagtcgcccaccaccatacctggctaattttttgtatttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttttggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaa

SEQ ID NO: 164652 - DNA, 1773 bp, Homo sapiens
  Payload ID: 12439
  Gene Symbol: PGAM5
  Gene Name: PGAM family member 5, serine/threonine protein phosphatase, mitochondrial
  ENST ID: ENST00000543955
  CDS Start-End: 865-1287
gtttggggccggggtcgggatgggggtcagggcaggtgttaccgttgggatcgagatcgggaccaggtttaaggttgcgatcgggtcgggatctggggtcgccgtctgctttccccagcggaggagccgctttccggggccgctctgcgcggagggttccgggggcggctgacccttcccgccggcttctgtggccgagctccgtcgcgtcctcgcccttctccccgcccctgcgagtccgccctgggtgccatcgccggagcgcgggccggggcgaggctgaggtggaagccgggcctccttcaggggcgtttgcaggagcgcgcccgcgagctgcgtgcggttattgagcgtttgaaatatggctcgtgtgattcctgaagggaatgcttagtttacgtcaatttaaacttaacgcaagcagggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctggg

SEQ ID NO: 164653 - DNA, 6390 bp, Homo sapiens
  Payload ID: 12440
  Gene Symbol: PHLPP1
  Gene Name: PH domain and leucine rich repeat protein phosphatase 1
  Uniprot ID: O60346
  ENST ID: ENST00000262719
  CDS Start-End: 235-5388
gcggggagggcgtgtgtcgggggggcggtggcggcgaggcgggcgcgcgggatggaacactgagacaccgacggaatgctccgaatcgccacataatcccctggaacggccgcgcacaacgccattggcttctcccttctccgcgcgccgccgccgtctcccacctccgcctcatcgcctccctctccgcccgctgcctccggagctgggggggaaacgcgaagccccactgcaatggagcccgccgccgcggccacggtacagcgactccccgagctcggcagggaggaccgagcttcggctccggcggccgccgctgcggcagcagcagcagcagcggcggccgcggcggctctggcggcggcggccgggggcggccggagtccggagcccgcgctgaccccggcggccccgagcggcgggaacggcagcggcagcggggcgcgggaagaggccccaggcgaggcgccgccggggccgctgccgggcagagcggggggtgccgggcgcaggaggcggcgcggggcgccccagcccattgccggcggggctgcccccgtacccggggccggcggcggcgccaactccctcctgctgaggagagggcggctgaagaggaatctgtccgcggccgccgcggccgcctcctcgtcgtcgtcgtcctcggccgctgctgcctcgcactcccccggcgctgccggcctccccgcctcctgctcggcctcggcgtcgctgtgcacccggagcctggacaggaagacgctgcttctgaagcaccggcagacgctgcagctgcagccgtcggaccgggactgggtgaggcaccagctccagcgcggctgcgtgcacgtcttcgaccgccacatggcctcgacctacctgcgcccggtgctctgcacactggacaccacggccggcgaggtggccgcccgcctgctgcagctgggccacaaaggcggcggcgtggtgaaggtgctgggccaggggcccggagccgccgccgcccgggagcccgctgaaccgccccccgaggccggcccccggctggcgcccccggagccgcgggactcggaggtaccgcccgcgaggagcgcgccgggtgccttcggggggcctccgcgcgcgccccccgccgacctacccctgcccgtcggcggcccgggcgggtggtcgcgccgcgccagcccagcgccctcggactccagccccggcgagccgttcgttgggggccctgtctcttcgccccgcgccccacggcctgtggtctccgacaccgagagcttcagtctgagtcccagcgccgagagcgtgtctgaccggttggacccctacagcagcggcggcggctcctcgtcgtcgtcggaagagctcgaggccgacgcagcctcggccccgacgggggtcccgggccagccccgccgtcccggccaccccgcgcagcccctcccgcttccccagacggcttcctcgcctcagccgcagcagaaagccccgagggccattgacagcccgggcggggccgtccgcgaggggtcgtgcgaggagaaggcagcggcagccgtggccccgggaggcctccagtctacccccgggaggagcggggtgaccgcggagaaggcgcctccgccgcccccgccgcccaccctgtacgtgcagctccacggagagaccacccggcgcttggaggcggaggagaagccattgcagatccaaaatgactacctcttccaactgggatttggggagctgtggagggtgcaggaggaaggcatggactcggagattggctgcctcatccgcttctatgcaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagta

SEQ ID NO: 164654 - DNA, 591 bp, Homo sapiens
  Payload ID: 12440
  Gene Symbol: PHLPP1
  Gene Name: PH domain and leucine rich repeat protein phosphatase 1
  ENST ID: ENST00000591386
  CDS Start-End: 1-591
ctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgcct

SEQ ID NO: 164655 - DNA, 8467 bp, Homo sapiens
  Payload ID: 12441
  Gene Symbol: PHLPP2
  Gene Name: PH domain and leucine rich repeat protein phosphatase 2
  Uniprot ID: Q6ZVD8
  ENST ID: ENST00000393524
  CDS Start-End: 735-4505
tttttttgtattttttagtagagatagggtttcaccatgctggccaggctggtctcgaattcctgacctcaggtgatccgccagccttggcctcccaaagtgctgggattacagatgtgagccactgtgcccaggcaaaatattaaaatttctatttttgagagacaaggtctcgctctgtcacccagatagggttgcagtggcacaatcacggctcactgcaacctcaatctcccgggttcaatctgttctccaactcaatctgttctccaccctcaagtagctgggactacaggcgtgtgccaccatgcctggctaatatataaaaaaaaatttcttttgtagagatgggatgttgccatcttacctaggctagtcttgaactcctggcctcaagcagtcctcttaccttggccccccaaagtgctgggattacaggcctgagccactgcaacccgctgtttcgttattcttgacacgtttctgaaaacacaaggaaaagagaggtcaacgaagatgatggatggaaacacagacagcagtaaagaaaattaagttatctgagttattacgaatgagcatgatagatgtgaagtgctccacaaaaggaggggatacttgagcagaatgttggggaatataaagtagagagaggtggggtgaggactgaaatgtctaattcagtcagatgttctagctaacgatttctttctcttgatattttttagagaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaacaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttgttataggcgataccaaaactgattattcttttttgcagtctgctttaattcatgtccttctgcagttgctctgtattaaaacagggtaaaaaggccatagcccattatgaaaaatataatacaaaactctttgacctatgaggtaacttacagacattgtgttttctaaacaggctgtcagtgaaagcccgtatctgtctccaggtgaatgtaatttacttccgagtactttacccagaggatgtgttccccaggtgggcagagtacagttgatctctagcacagacagagattctggcctctgcatattctcaggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgttggtatgacataaagctgcagtgcactatagagtcaagtcattgaattaccactcctgatacagggctttattgtactactgtgaagtgtatgtgtgcaatacattggtgagttcatttactggtgtacggaagagccagcaggagcagcgtggtcattgctgggtgctattacagttgcttgtagtgagtgctgttttccaggagatggagccagttgggtgtggcagatctactgaatatcaaatgatgctcttcttcccatgtagaccttcagcaaaagccggtacttggaagccacaggctcaccttctctatctatccaataattattaatgaagagacctccataagggagcagctggctgttatcgataaatgtaccaattattaaataattagtctccaagccattcagtgatgtcttcagcatcactataggactgtctagtgtcactttttacttccttctgggtggaggctttccgactcccaatcatgaaggcaagttaatctttccagttagtgacttttgccccatagttggggtaagcacttcctagattgagaaaaagcagctacagtcaatcctgctctgtttgcctcatttggtgatcagtcagtcacacataagttccttgtattctaaatttcatgcacttctcccagatgctatagggttttctctcactgttgccagtggatgtcatccagacagtgggctcatatcttacggttttgtgcaatcattgtcgtattgtagtcttaagactcattatagtgtatttttgatatttttgaaatgtgttaaattttttaattcaataatatgagccagagcatgttgcagcaaatctattgtttgtaaaaataacaataacaataataaataaaataaagtggaatctttttcatggctttgtttt

SEQ ID NO: 164656 - DNA, 4812 bp, Homo sapiens
  Payload ID: 12441
  Gene Symbol: PHLPP2
  Gene Name: PH domain and leucine rich repeat protein phosphatase 2
  ENST ID: ENST00000567016
  CDS Start-End: 16-4092
aatcctgggtcgccgatgggggaggtggagccggggcccgcgggcccgctggagcccccggagccgcccgaagcgcccgcgagccgccggccgggagggatccgggtcctgaagagaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaatctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtga

SEQ ID NO: 164657 - DNA, 2077 bp, Homo sapiens
  Payload ID: 12441
  Gene Symbol: PHLPP2
  Gene Name: PH domain and leucine rich repeat protein phosphatase 2
  ENST ID: ENST00000564884
  CDS Start-End: 1-959
ctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagagaattgggttcttaaccaaaagcacctgcaggattttcctggggaagataagtgagaacaaacacatgaaaccacattccctgacactgcaaagctatgagttaaggttccggaagatctcaaagagttccagaccacagatattccggtgcatcactgtaacttccgggctgttctcggctgcctttgtagcgcttctgttctcggtagctacgcagggccagcaccacgctggcgccgtacatgatcacgagaagacaagcaaaggtggctgctgctccgtcggtgcctgccagctggcagtccatccaggtgagacccttgcgggcatagagcctctctcttgttttgcaagtgtcggtgctattgatctgcagagccacgtggaggtaaacaccaatgcctgtgcagtagcccactgccgctaggaggctgaaggcggcctccgtgaggagccacttccctgacaacattgttcgactcttggctccttggagtaaaacacccatggtgaggacccccagacccagagaaacagccacgccaccgtatatcaggggcgagcggaggatcgtgtactgctggtccagctgccgaacctgctctagctcagtgccctcgaacgatgttttcagatcagttcctacaagaggagccacattttgttaagtggccttcgacttcattgtatggatggatttgtctattcaaccaggaccttactgatagatatttggactgaaaggaacccacaaatggcacgaggcagaggaagccaacaggccaacagactgaagatcttcttgtccgaggtcagcttttatttgttactgacagaggccccaaatccttcttaggtgtccttctgggagagggtctcctgccattcccgtggtgttcagggatgagcatgaagagaaatacaaatgaaccgagagcaggaccaccaggttcaagtccccgctttttactgccttgtcatcttggccaagccattcagtccttctaagcctcagacaatatgacaaatgaagctaagtctgccaatcttcacccacagggatgtggggaggctcaaatgaaagcaaccgtgtgatactgtgggaagttaacaacaacaacaaaaaagcaagtatgtgaaaatactctaaaaataaaataatgtacaaatgg

SEQ ID NO: 164658 - DNA, 8317 bp, Homo sapiens
  Payload ID: 12441
  Gene Symbol: PHLPP2
  Gene Name: PH domain and leucine rich repeat protein phosphatase 2
  Uniprot ID: Q6ZVD8
  ENST ID: ENST00000568954
  CDS Start-End: 380-4351
gcacaggggtatagatctaaagaagggcagaggggagatctggaaacaggctggctgactccaaatttggcccattggcaacaaaactactatcactgcgagaacgaaaagaaaaacaaaacaaagaaaagaaaagaagttaacttttaaaagtttttttctgaatcagccttgcaaataaatcataaaccgggtcacaggccatattactgcttgaagcagagcaccgaattctgataattttgctccaggaggaggcaagggaattaaaacatggctgggaggtgagcggacgttttgtacgaggttgggttgaatttgcttaagaaggtcgcacgcatctctgataaggaagagaaaaggccttgccaagagaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaatctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttgttataggcgataccaaaactgattattcttttttgcagtctgctttaattcatgtccttctgcagttgctctgtattaaaacagggtaaaaaggccatagcccattatgaaaaatataatacaaaactctttgacctatgaggtaacttacagacattgtgttttctaaacaggctgtcagtgaaagcccgtatctgtctccaggtgaatgtaatttacttccgagtactttacccagaggatgtgttccccaggtgggcagagtacagttgatctctagcacagacagagattctggcctctgcatattctcaggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgttggtatgacataaagctgcagtgcactatagagtcaagtcattgaattaccactcctgatacagggctttattgtactactgtgaagtgtatgtgtgcaatacattggtgagttcatttactggtgtacggaagagccagcaggagcagcgtggtcattgctgggtgctattacagttgcttgtagtgagtgctgttttccaggagatggagccagttgggtgtggcagatctactgaatatcaaatgatgctcttcttcccatgtagaccttcagcaaaagccggtacttggaagccacaggctcaccttctctatctatccaataattattaatgaagagacctccataagggagcagctggctgttatcgataaatgtaccaattattaaataattagtctccaagccattcagtgatgtcttcagcatcactataggactgtctagtgtcactttttacttccttctgggtggaggctttccgactcccaatcatgaaggcaagttaatctttccagttagtgacttttgccccatagttggggtaagcacttcctagattgagaaaaagcagctacagtcaatcctgctctgtttgcctcatttggtgatcagtcagtcacacataagttccttgtattctaaatttcatgcacttctcccagatgctatagggttttctctcactgttgccagtggatgtcatccagacagtgggctcatatcttacggttttgtgcaatcattgtcgtattgtagtcttaagactcattatagtgtatttttgatatttttgaaatgtgttaaattttttaattcaataatatgagccagagcatgttgcagcaaatctattgtttgtaaaaataacaataacaataataaataaaataaagtggaatctttttcatggctttgttttaaaa

SEQ ID NO: 164659 - DNA, 3099 bp, Homo sapiens
  Payload ID: 12441
  Gene Symbol: PHLPP2
  Gene Name: PH domain and leucine rich repeat protein phosphatase 2
  ENST ID: ENST00000568004
  CDS Start-End: 1-2172
gaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaatctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggttccggaagatctcaaagagttccagaccacagatattccggtgcatcactgtaacttccgggctgttctcggctgcctttgtagcgcttctgttctcggtagctacgcagggccagcaccacgctggcgccgtacatgatcacgagaagacaagcaaaggtggctgctgctccgtcggtgcctgccagctggcagtccatccaggtgagacccttgcgggcatagagcctctctcttgttttgcaagtgtcggtgctattgatctgcagagccacgtggaggtaaacaccaatgcctgtgcagtagcccactgccgctaggaggctgaaggcggcctccgtgaggagccacttccctgacaacattgttcgactcttggctccttggagtaaaacacccatggtgaggacccccagacccagagaaacagccacgccaccgtatatcaggggcgagcggaggatcgtgtactgctggtccagctgccgaacctgctctagctcagtgccctcgaacgatgttttcagatcagttcctacaagaggagccacattttgttaagtggccttcgacttcattgtatggatggatttgtctattcaaccaggaccttactgatagatatttggactgaaaggaacccacaaatggcacgaggcagaggaagccaacaggccaacagactgaagatcttcttgtccgaggtcagcttttatttgttactgacagaggccccaaatccttcttaggtgtccttctgggagagggtctcctgccattcccgtggtgttcagggatgagcatgaagagaaatacaaatgaaccgagagcaggaccaccaggttcaagtccccgctttttactgccttgtcatcttggccaagccattcagtccttctaagcctcagacaatatgacaaatgaagctaagtctgccaatcttcacccacagggatgtggggaggctcaaatgaaagcaaccgtgtgatactgtgggaagttaacaacaacaacaaaaaagcaagtatgtgaaaatactctaaaaataaaataatgtacaaatgga

SEQ ID NO: 164660 - DNA, 760 bp, Homo sapiens
  Payload ID: 12442
  Gene Symbol:
  Gene Name: PHACTR1
  ENST ID: ENST00000635196
  CDS Start-End: 1-693
aacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgccagtgagtctggagtcctcctgtcccaagatccttcagccaaaccagtcctgctactgccccccaaaaaacctgctgctttccctggagaccatgaagagaccccagtgaagcagctgccccttctcaagcagcccccggccctgcctcccaaacccactaccaggattgccaaccacttaacagattggcaccaagctcaccaggtaggacagcggcaccctctgcctccctggcagtgggcctttagctctccaggttctagcaaaagaattcagtctcggccgggcgcagtagcttatgcctgtaatcccagcactttgggaggccgaggcaggtggatcacatgaggtcaggagttcaagaccagcctggccaacatggtgaaaccccatctctactaaaaatgcaaaaatt

SEQ ID NO: 164661 - DNA, 943 bp, Homo sapiens
  Payload ID: 12442
  Gene Symbol:
  Gene Name: PHACTR1
  ENST ID: ENST00000634261
  CDS Start-End: 106-540
gtgcctctcctgggcttgaaattgaggaactgaggaggcggtggtggcgagagtcagtctttcagagcacaggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaagggg

SEQ ID NO: 164662 - DNA, 792 bp, Homo sapiens
  Payload ID: 12442
  Gene Symbol:
  Gene Name: PHACTR1
  ENST ID: ENST00000635715
  CDS Start-End: 1-792
ctctcccttcacccctttctctcctttgctctctttctttctctctcccttttttttcctttttccctctctttcccactccctccccaccccttcccttcctctcccctcccccttcccctccccctcccccgtgcgcgagcctcttcctctcccctcctcccccttccgcctctctccctctccctccgtctccttctccctctcagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgc

SEQ ID NO: 164663 - DNA, 4784 bp, Homo sapiens
  Payload ID: 12442
  Gene Symbol:
  Gene Name: PHACTR1
  ENST ID: ENST00000635308
  CDS Start-End: 130-1584
tatttagcaagatcaaagacactctggctggaacggctcttgttttaccgctgacagatagcctttgatttttattttttgcagtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacgtaagtgactaagcccatggcaatccctgatgttttgtggcggcttttgttattatttaatggtaggccacaaggtttctaccttgcgcctctgcggaaagcattgaaaacctttctaacggttgaagcttcatgtgtgcatgttagaacaccaaagacgacctccccaaagagaaggcaaattttattccactttattctttagaagctcacgggcggcaggcagaaccttccttttagtgagttgtaaagtcagagagaagctgaaaaattagagtgagaccacttattatttaatgatttttaagagcagggtcacctttaaaccagaattggcttgaaaatggagactgtgatatgcacggctaaaataagggaaatgtccatttgaactgagactagaaagcatgactttgcattgcagctggctgctgttgataaaaatccctcatccctttgaatgttaaattgaaagactaagaaagcatttccaagtgaagtgcttcatgtctgtctctcaggattcccacagctggtcccgggcatgcctgtctgatgctctcattcgaggaaaactgcctttcaccattgctgcagacagaaaaaaataaatgagccccttgtttggtttaggacacagagacatttgaatatgtacagaggatccacttggtgctttaaaaaaaaaaagagaaaacaggatacaaaatactaaaagagatcaagcatttgatggacagcagtatgcgtcagtttagtggtagatattaaataacttaaatatcaaaccattctattcattcattgctaccattctcgccaacactggcctcaagatagtgaacaaatatttctggcttaattcatgaccctgttccccctaccccacaacacacttctaatttctctccagaagagaaagatatatactatgcagagttttctagaaatgctatgttgtacagactgactccttgcctcccccggcccccccgccccgccccgccccgtgcccagtaaatcacatgcaaccgcagtgtgagtttgccgggaatttccactgaaaccacactaagatattcttgactttacctttctaccgtgctcactgtggccttgtgacttggtcggcatttcgtagtctgctgaaggtgggtgctgggttccgctttggtggggagacctgttgcctacagcacccacccccgcccgacgcccccgcatgtccgtttatgtcaactctgcctttatcaatgtcttgcctcccgtccccacgccagccgccacttcctcaactctcagtagaagttattttcaggattagccttcctcagtcgtgggggaaccctacgctttgcctaggtctctaggaatgtgtgtttacttttttctgcccaaggggtaccctttaaagtttccaagcttaatattctatataatgaattcagagctttttcaaagcatttccaaggtcagggaagcatttggcttgtaggatgtcttcctttcggccccaatctggtacctgagccattataaacttcccattgttggagagaaagataaacagccaggtgaacctgtacaacttactcacagcccgctgctgtacttgtggcctctgacctgagacctaaactcaaagaagctaaaagcctccgggggattatttaggtttcagaaaatagtgcttatcacaccaggagtacggtttctggagagatctaaaatcccctagctcagctctgggctctctcaaagatatcagatccccgctgtggcttgtccagatccctgggagactacaggtcctttgagcttgggtttttaccgccatcaaccagggaacttagattcaggggaccaaaaaggagttgtgaaagattgttcccatggttctcttttattctcttccctaatccctcttgtcctggccacatagttgcaaattaaagaactacttgaccaattctaacaggttggtcatttcatagttttgaaacttttcagaaatcaacttgttttcccataggttcttatttttccctgtattctggaactatgttctcctaaatatttttttaaatttaatctattgcgattgttaaacaaaaaaaatgtctagtggtataagaaaacatcctccaatagtttgttttaaaactgattttctgagctttcagccatttgaggaactgctcggtgttgggtggtggggaacagggcacagagatgccatggctcagccctggagctttgagagccttgggttggtttccagccccaccctgcctggtcctgggagcagcccctgttctgtccagcagccagtgaggccctgtgcacctctgagcacataatgaaccctctgacggtggcagctgtaatgacgacatcgtaggcctttcctggcctgtcttcctagttgcctaatggggttgtcttggtaccttctgcctgaaaattcatgaacctgggttggtcaatggctttgaactaaaggtatcaattctgtaggtggtagcttgtggccccacccctcagagtgacctaagaaacgcacataggagatgaaggctccatgctgtgtcagctgtgtcacaggatgcccgccttcacggctctgaagggacctgtaggatcagaagtctgaggctagtaatgaggaggagagccggccccacacaaaacatgaccacaggaaaaaacctatctgtgtaaccactgagccaggtagggtgtgactggccacttaacacccctgaggcttcagatcctcagttataaaccaggagtggtagacgaggtggtcactaggtcccctcatggccctagtattctgtgcttctgtaaattttcaccgtgtgccctctagctgtccctggtgacccaacatccagaccaccttttcttccatccgttttcccacctgagacatcgcaaaatgggagttccctccttctggttcttgctgtctgcctccccatttaactctgctagattaattcatactaagatattaatggctgactagtttaataggttttatcccactgaaatttgcatttgtacaaatgtcactgtctgggggctccctacttccgggtgttgctgtctgccccccagtttatctctactagattaattcatactgagctattaatggctgactagtttaatgggcttttattcaagagaaatttgcatt

SEQ ID NO: 164664 - DNA, 707 bp, Homo sapiens
  Payload ID: 12442
  Gene Symbol:
  Gene Name: PHACTR1
  ENST ID: ENST00000634449
  CDS Start-End: 21-443
ctccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagtaagcagaggggagtgctggagagtgggaggcaggaccgtctgctgggtctcgctgggctcaccgctggggagcgtgtagggagacctgcagccaggcctcagccgcagtccccataatggagtgttgagaccccaacacctttccccaggggccacagataatctgcggaaaggctgctgaatcggagaaaacacaaggcacataatactgtgcccattttacaggaggaggagcagcagcctgggaggctgtgcccagagaaagagaatagcactggataggtgtagacaggtgaaggcaagaggctccaggctcatcacagcccttccgtataggggatgg

SEQ ID NO: 164665 - DNA, 2257 bp, Homo sapiens
  Payload ID: 12442
  Gene Symbol:
  Gene Name: PHACTR1
  ENST ID: ENST00000635526
  CDS Start-End: 29-1495
agctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtcc

SEQ ID NO: 164666 - DNA, 5332 bp, Homo sapiens
  Payload ID: 12442
  Gene Symbol:
  Gene Name: PHACTR1
  ENST ID: ENST00000634438
  CDS Start-End: 184-1926
aagctgttcatttgtgcttgcgggctcagaagcgtcgcactgctttgttttgtactctaccgtgtcctgttgaaaggggtcaacaagtgccggggagggtgcagaggctgaggctggcgtcaccttccgttgctaaggtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtccagagtgtccagtgtcatgagtgacccacgcacacacacagccattgctaaggtactcctgtgctgtttataagtctgagtgggaggaccctattgaatcctgtggggtcagaaactgcttggctgacatttattttctctgtgcgccttgaagctgattatatggcttgggagttcttagcttctgtgtataggaccagtgcatgcaggccagaaaccactcctgtaggactggctttccagccactgagggacttggaaccactccatggccttctcttttttttttttttttttttttttttttttttttttgcactgaagagtttctgtgaaggagccccagagttgggcatgtgccagaatcaggccaacaccagccacacctgtccacagtgccccttcctgctccagttgatccagagagctcctccctctaccctcatgatgccagggagcgtgactgtgggtgtgtctctgactgggacacccaggatagggtgtgcgatgaggccaggaccctcctaaaccctaacagcatcctaacgaggcccattgcagctttcgatttccttcataacagagctcgcaggccctcagttgcagagctctctcaccttctggagtgactccatcgttactccagtctttctaggtggtggaactctccaccacacatgccatttagaaagacgccagcttggcctttccaaaaagttaaccagtcgtctccccaccacaaaccctgtgggagcaggttactcttaggatgcacacccgtcaacgaggccattgcatttttttgcaggcatgaacggctcccatctaggcactaacccaggagccaaacaactgctggggagagttcagggcagctctttgggcggtgcctccagctgcagctttgccttgccacctggagccagcacgcctctgcccgacccaaggaggatgccatcactagatcctattttttttttttttttttaactcttgaatctgaatagttcctgccgtggggagaggtattgttcagggaaaatgtgatcgggattttagtgtggctgtaaacacagtcttcccgaaaggcttactgacgtttgaatgtgcaaatggtatgacgaaagatgtagggctctttcgttgaacttctctacggcgggcgggcggacacgtgttccaggtggacttgcctgccggccaggctttgagtctgaacttcctctaactgcagctgggctcctggcacacgcggtgccctggcatgatggtcctccctggccaggagcgagtcctaaggaaattcattccattgaccggactcctcccatgataggcccatggcttctctgctggccttagttcttggcccttcagattccctggggatataaggcccaagcggatctccctgcagccagccagcagacagcccagggtttccgcccaaagtgccctcatgttgcagtccactttgtgcatggaagatattgaacacaatttccactgctcttcctgcagggcctcctttccagcagtcacttgctcagactgaggggtgcacctcccctgccattgacaggtcctgcgccttcaggatgggctatttcaagcccgttttaagtggctcttacacaggctcagcaacctctgtggcctgcaggatgggccttctgctgtctctttcctttcttaaaaccttaaggtctttctagagacctattcaattttctttttttttttttttcactacaatgtcatgacaactgcagcaatttgtgttactttccaagatgacaatttgacattaattaagggaaaaaataaaaaggtgagctagatgacttaaaatgcatctcttttttgaaaaagctgtagctggcaagtcaaagtttattttatgtgtgtaaattcccagttgagcatttttttcatttggattagcgtgagaggaaaaatgtgaaatgtctcaaatcaaatgcttccttctaaagattagacattgcccaaccctgcccccgcccccaatcaatcagtgacagaagagaccgccatcagccaactagctttttttaaatggctgatatattcatctctaaaggccctcaaagcactgtaaaacttttaaaactttagcctttatgtcagattagagaaaccaaacaatgtgacggtacatgtgatgaaaagctctgggtttatttttctcccgcttatgaacatgtatttttatttgccgaatgaaaatcgtggtgtgttgctttgatgaatggaatttcaggctctccctgtgcacagccggtgggcaaaggtcaccttaaatgactttttctccctatctgtctgttaatccccagaccggttgcattttccagttgcttcctgggtgtctgtacatagtttgtctttgtataggagtgagtgtggtgaccgtcaatcccctaatctcccaggttctaatttaacagatgatggctgtatgaggaaaacgatgtaaatagagaatacaaattaaactggatctctgtggcctaggttttgtacatacagaaactgcatggtatttaaattattgtttgtctctgatgatgtatgcagtttctttaaaaacaaaccaaaaaaaagtaaaaaaaaaaaaaaaaaaa

SEQ ID NO: 164667 - DNA, 795 bp, Homo sapiens
  Payload ID: 12442
  Gene Symbol:
  Gene Name: PHACTR1
  ENST ID: ENST00000635242
  CDS Start-End: 178-687
gatgagctgaggatcaacactcacaacggctgacacttaatgacgctatttatcaaatagaccttttgaaaactgatagcatgtgaatttaacagtatatgttccagagaatataaagcaaggaaaggctggtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcaggcgtttccctttttggggatatggatgaagcaagaatgggaccagcagtgccaactcttgggcgtcctcttgggctcgaactgtgttccctggaaaaccacggcctcctgaagacagcccctacatacactacatcagcccacatctgctcaggccccagtacaggtggacaattctctactcagggtatgagccctgttcaaggagctaagagaaggagggtggtttggctgcctttagagggggaagagtttggctgagaggacatttactctttggtccatatgggaagggaaaatgcgggttggcgtgtgtattcatttcctagagttgctgtaacaaagtaccacaaactacatgacataaaa

SEQ ID NO: 164668 - DNA, 5523 bp, Homo sapiens
  Payload ID: 12443
  Gene Symbol: PHRF1
  Gene Name: PHD and ring finger domains 1
  Uniprot ID: Q9P1Y6
  ENST ID: ENST00000264555
  CDS Start-End: 129-5078
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggtgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaa

SEQ ID NO: 164669 - DNA, 5224 bp, Homo sapiens
  Payload ID: 12443
  Gene Symbol: PHRF1
  Gene Name: PHD and ring finger domains 1
  ENST ID: ENST00000413872
  CDS Start-End: 94-5037
gcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggtgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacc

SEQ ID NO: 164670 - DNA, 5227 bp, Homo sapiens
  Payload ID: 12443
  Gene Symbol: PHRF1
  Gene Name: PHD and ring finger domains 1
  Uniprot ID: Q9P1Y6
  ENST ID: ENST00000416188
  CDS Start-End: 94-5040
gcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggtgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacc

SEQ ID NO: 164671 - DNA, 5218 bp, Homo sapiens
  Payload ID: 12443
  Gene Symbol: PHRF1
  Gene Name: PHD and ring finger domains 1
  ENST ID: ENST00000533464
  CDS Start-End: 94-5031
gcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggtgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacc

SEQ ID NO: 164672 - DNA, 5178 bp, Homo sapiens
  Payload ID: 12443
  Gene Symbol: PHRF1
  Gene Name: PHD and ring finger domains 1
  Uniprot ID: Q9P1Y6
  ENST ID: ENST00000534320
  CDS Start-End: 129-4613
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggtgttctccgagctgccctttcccagtcacgtgcttccggaacccgggttcccagacacagacccctctcagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaa

SEQ ID NO: 164673 - DNA, 5523 bp, Homo sapiens
  Payload ID: 12443
  Gene Symbol: PHRF1
  Gene Name: PHD and ring finger domains 1
  Uniprot ID: Q9P1Y6
  ENST ID: ENST00000616346
  CDS Start-End: 129-5078
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaa

SEQ ID NO: 164674 - DNA, 5218 bp, Homo sapiens
  Payload ID: 12443
  Gene Symbol: PHRF1
  Gene Name: PHD and ring finger domains 1
  ENST ID: ENST00000632297
  CDS Start-End: 94-5031
gcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacc

SEQ ID NO: 164675 - DNA, 5227 bp, Homo sapiens
  Payload ID: 12443
  Gene Symbol: PHRF1
  Gene Name: PHD and ring finger domains 1
  ENST ID: ENST00000633631
  CDS Start-End: 94-5040
gcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacc

SEQ ID NO: 164676 - DNA, 5178 bp, Homo sapiens
  Payload ID: 12443
  Gene Symbol: PHRF1
  Gene Name: PHD and ring finger domains 1
  ENST ID: ENST00000633057
  CDS Start-End: 129-4613
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaa

SEQ ID NO: 164677 - DNA, 5224 bp, Homo sapiens
  Payload ID: 12443
  Gene Symbol: PHRF1
  Gene Name: PHD and ring finger domains 1
  ENST ID: ENST00000634091
  CDS Start-End: 94-5037
gcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacc

SEQ ID NO: 164678 - DNA, 2224 bp, Homo sapiens
  Payload ID: 12444
  Gene Symbol: PHF1
  Gene Name: PHD finger protein 1
  Uniprot ID: O43189
  ENST ID: ENST00000374512
  CDS Start-End: 272-1645
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaggctcctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 164679 - DNA, 2330 bp, Homo sapiens
  Payload ID: 12444
  Gene Symbol: PHF1
  Gene Name: PHD finger protein 1
  Uniprot ID: O43189
  ENST ID: ENST00000374516
  CDS Start-End: 272-1975
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaggctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 164680 - DNA, 2330 bp, Homo sapiens
  Payload ID: 12444
  Gene Symbol: PHF1
  Gene Name: PHD finger protein 1
  Uniprot ID: O43189
  ENST ID: ENST00000427869
  CDS Start-End: 272-1975
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 164681 - DNA, 836 bp, Homo sapiens
  Payload ID: 12444
  Gene Symbol: PHF1
  Gene Name: PHD finger protein 1
  ENST ID: ENST00000428274
  CDS Start-End: 154-836
ttccctcgtgccccaagggcgaatctcaggtcggaggaaggggctgaggggattccctctcccaccgggtccgactcttcgctccccaagccgcggagggccagcctcttcttcggcgccctccaggcctgttggaggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacag

SEQ ID NO: 164682 - DNA, 609 bp, Homo sapiens
  Payload ID: 12444
  Gene Symbol: PHF1
  Gene Name: PHD finger protein 1
  ENST ID: ENST00000421466
  CDS Start-End: 174-609
aagcacggggcgggacgtccacgggaagcggcgcgcacgcccgccgactccctcgcgccaaccgccgacggccgccgcccggtgaaggaggggctcagtcctcccaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccacca

SEQ ID NO: 164683 - DNA, 836 bp, Homo sapiens; identical to SEQ ID NO: 164681
  Payload ID: 12444
  Gene Symbol: PHF1
  Gene Name: PHD finger protein 1
  ENST ID: ENST00000447305
  CDS Start-End: 154-836

SEQ ID NO: 164684 - DNA, 862 bp, Homo sapiens
  Payload ID: 12444
  Gene Symbol: PHF1
  Gene Name: PHD finger protein 1
  ENST ID: ENST00000423868
  CDS Start-End: 1-546
tggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccaggtcaccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatg

SEQ ID NO: 164685 - DNA, 862 bp, Homo sapiens; identical to SEQ ID NO: 164684
  Payload ID: 12444
  Gene Symbol: PHF1
  Gene Name: PHD finger protein 1
  ENST ID: ENST00000427826
  CDS Start-End: 1-112

SEQ ID NO: 164686 - DNA, 2224 bp, Homo sapiens
  Payload ID: 12444
  Gene Symbol: PHF1
  Gene Name: PHD finger protein 1
  Uniprot ID: O43189
  ENST ID: ENST00000454914
  CDS Start-End: 272-1645
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 164687 - DNA, 609 bp, Homo sapiens; identical to SEQ ID NO: 164682
  Payload ID: 12444
  Gene Symbol: PHF1
  Gene Name: PHD finger protein 1
  ENST ID: ENST00000427004
  CDS Start-End: 174-609

SEQ ID NO: 164688 - DNA, 728 bp, Homo sapiens
  Payload ID: 12444
  Gene Symbol: PHF1
  Gene Name: PHD finger protein 1
  ENST ID: ENST00000419154
  CDS Start-End: 1-728
ctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatg

SEQ ID NO: 164689 - DNA, 1930 bp, Homo sapiens
  Payload ID: 12444
  Gene Symbol: PHF1
  Gene Name: PHD finger protein 1
  ENST ID: ENST00000487667
  CDS Start-End: 543-1724
agctaacggatgtggcatggggcgggggaccaggccggaggcgggctgccgggaggggggattccctcgtgccccaagggcgaatctcaggtcggaggaaggggctgaggggattccctctcccaccgggtccgactcttcgctccccaagccgcggagggccagcctcttcttcggcgccctccaggcctgttggaggtgagggaggtggggtgaggtggtgcccgcccccccctccggctcctcctttcccccagtcctcccctcccaccaccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaggctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcaccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcga

SEQ ID NO: 164690 - DNA, 1930 bp, Homo sapiens
  Payload ID: 12444
  Gene Symbol: PHF1
  Gene Name: PHD finger protein 1
  ENST ID: ENST00000495185
  CDS Start-End: 543-1724
agctaacggatgtggcatggggcgggggaccaggccggaggcgggctgccgggaggggggattccctcgtgccccaagggcgaatctcaggtcggaggaaggggctgaggggattccctctcccaccgggtccgactcttcgctccccaagccgcggagggccagcctcttcttcggcgccctccaggcctgttggaggtgagggaggtggggtgaggtggtgcccgcccccccctccggctcctcctttcccccagtcctcccctcccaccaccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcaccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcga

SEQ ID NO: 164691 - DNA, 1752 bp, Homo sapiens
  Payload ID: 12444
  Gene Symbol: PHF1
  Gene Name: PHD finger protein 1
  ENST ID: ENST00000495509
  CDS Start-End: 107-1366
acgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaggctcctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatg

SEQ ID NO: 164692 - DNA, 1189 bp, Homo sapiens
  Payload ID: 12444
  Gene Symbol: PHF1
  Gene Name: PHD finger protein 1
  ENST ID: ENST00000475137
  CDS Start-End: 685-849
cctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctact

SEQ ID NO: 164693 - DNA, 461 bp, Homo sapiens
  Payload ID: 12444
  Gene Symbol: PHF1
  Gene Name: PHD finger protein 1
  ENST ID: ENST00000459809
  CDS Start-End: 147-311
gtgccccaagggcgaatctcaggtcggaggaaggggctgaggggattccctctcccaccgggtccgactcttcgctccccaagccgcggagggccagcctcttcttcggcgccctccaggcctgttggaggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtga

SEQ ID NO: 164694 - DNA, 1719 bp, Homo sapiens
  Payload ID: 12445
  Gene Symbol: PHF10
  Gene Name: PHD finger protein 10
  Uniprot ID: Q8WUB8
  ENST ID: ENST00000339209
  CDS Start-End: 125-1621
gggggcggggccggggcggcggggggcccgcgcggcggcggcggcggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaa

SEQ ID NO: 164695 - DNA, 1589 bp, Homo sapiens
  Payload ID: 12445
  Gene Symbol: PHF10
  Gene Name: PHD finger protein 10
  Uniprot ID: Q8WUB8
  ENST ID: ENST00000366780
  CDS Start-End: 1-1491
atggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaa

SEQ ID NO: 164696 - DNA, 4395 bp, Homo sapiens
  Payload ID: 12445
  Gene Symbol: PHF10
  Gene Name: PHD finger protein 10
  ENST ID: ENST00000612128
  CDS Start-End: 75-1208
cggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatggtggtagtaaaatagactaccttttgattcttttggtctgaaatgtattagaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattctttttgaa

SEQ ID NO: 164697 - DNA, 1651 bp, Homo sapiens
  Payload ID: 12445
  Gene Symbol: PHF10
  Gene Name: PHD finger protein 10
  Uniprot ID: Q8WUB8
  ENST ID: ENST00000621772
  CDS Start-End: 201-1556
cagacaagaagtgcggcggaagcttacacctgcacgtggtgggacagaggcaagaacggatggtctggctgaggctgagagaaccaagctggattaggatcggcttgagggcccggcgtcgtcagtggtgacctctctgacctgaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgc

SEQ ID NO: 164698 - DNA, 1471 bp, Homo sapiens
  Payload ID: 12446
  Gene Symbol: PHF11
  Gene Name: PHD finger protein 11
  Uniprot ID: Q9UIL8
  ENST ID: ENST00000357596
  CDS Start-End: 277-1155
agcccagtgcttccaccacaaccgatgtcaactctcctagcgcccctccgctcaccggtaaaccaggacagtggaggggcgccctgatgcgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatactacttta

SEQ ID NO: 164699 - DNA, 1359 bp, Homo sapiens
  Payload ID: 12446
  Gene Symbol: PHF11
  Gene Name: PHD finger protein 11
  Uniprot ID: Q9UIL8
  ENST ID: ENST00000378319
  CDS Start-End: 42-1037
gatctcgctatccggccgccacccgcagctgcagcacagtcatggcccaggcgtcgccgccccggcccgagagggtgctcggcgccagcagcccggaggcccggcccgcgcaggaggcgctcctccttcccaccggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatactactttacttgta

SEQ ID NO: 164700 - DNA, 903 bp, Homo sapiens
  Payload ID: 12446
  Gene Symbol: PHF11
  Gene Name: PHD finger protein 11
  ENST ID: ENST00000426879
  CDS Start-End: 1-860
gccgccccggcccgagagggtgctcggcgccagcagcccggaggcccggcccgcgcaggaggcgctcctccttcccaccgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatc

SEQ ID NO: 164701 - DNA, 610 bp, Homo sapiens
  Payload ID: 12446
  Gene Symbol: PHF11
  Gene Name: PHD finger protein 11
  ENST ID: ENST00000442195
  CDS Start-End: 107-610
gcttccaccacaaccgatgtcaactctcctagcgcccctccgctcaccggtaaaccaggacagtggaggggcgccctgatgcggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagag

SEQ ID NO: 164702 - DNA, 1318 bp, Homo sapiens
  Payload ID: 12446
  Gene Symbol: PHF11
  Gene Name: PHD finger protein 11
  Uniprot ID: Q9UIL8
  ENST ID: ENST00000488958
  CDS Start-End: 129-1007
cacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatacta

SEQ ID NO: 164703 - DNA, 1626 bp, Homo sapiens
  Payload ID: 12446
  Gene Symbol: PHF11
  Gene Name: PHD finger protein 11
  ENST ID: ENST00000465045
  CDS Start-End: 272-952
agtgcttccaccacaaccgatgtcaactctcctagcgcccctccgctcaccggtaaaccaggacagtggaggggcgccctgatgcgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagaccaagcacttcccaaacagtgtgcctgagaaccacctgtagggctggtgaggacacagatagctgggcctatcccacagagattctgattcagtacaaataccaagaattgggggccaggcgcggtggctcacgcctgtaatcccagcactttgggagcccgagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatacta

SEQ ID NO: 164704 - DNA, 795 bp, Homo sapiens
  Payload ID: 12446
  Gene Symbol: PHF11
  Gene Name: PHD finger protein 11
  ENST ID: ENST00000496612
  CDS Start-End: 397-795
ggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctcacgttcacggaggacgtgactggaacccgtctccccttctccagtcgttccagtcctccccggccctctacttgagtggggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaagctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcata

SEQ ID NO: 164705 - DNA, 566 bp, Homo sapiens
  Payload ID: 12446
  Gene Symbol: PHF11
  Gene Name: PHD finger protein 11
  ENST ID: ENST00000485919
  CDS Start-End: 272-566
agtgcttccaccacaaccgatgtcaactctcctagcgcccctccgctcaccggtaaaccaggacagtggaggggcgccctgatgcgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaaga

SEQ ID NO: 164706 - DNA, 1316 bp, Homo sapiens
  Payload ID: 12446
  Gene Symbol: PHF11
  Gene Name: PHD finger protein 11
  ENST ID: ENST00000621822
  CDS Start-End: 129-701
cacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaaaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatacta

SEQ ID NO: 164707 - DNA, 1173 bp, Homo sapiens
  Payload ID: 12446
  Gene Symbol: PHF11
  Gene Name: PHD finger protein 11
  ENST ID: ENST00000496623
  CDS Start-End: 33-512
atccggccgccacccgcagctgcagcacagtcatggcccaggcgtcgccgccccggcccgagagggtgctcggcgccagcagcccggaggcccggcccgcgcaggaggcgctcctccttcccaccggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataagtatttaataaaacatttttaaaaccacatttgggggattgggataaggaatggttggattaagacaaggagactttgaagactaattttatgtaaatggttttcaaatgagaacaaagccagtttgggggatgcacaggggttatgtgaattttgaatttcagtgaaaaatctatatatatatatatattattttagtcacaatatcttgaataatgagatcaatgttaggacagcatgtttttttaaatatgatttttgtgagctatgttacattcgtaagatgatttttaaaaattccattcagaggctgatgtttttcctgccagtgggcatatattcctaattttcccatagtgttccaggcactattttatttatttatttaataaccacttgctttatgccaggcatagttctaagtgctttacaaatgttaactcatttaatcctcataatagtcaactgaggtagatactattatctccattttccagaggaggaaactggggccttgagacactcagtgacttgtccccaggttacacagctggtcagtggcagagctgggctgcaggacttccaagtcctcgctctttgccaccttgttgtcttcaggtatggggactatatattctaaaacaagagggcaagcctaccattgaaagaagcttgctaaataa

SEQ ID NO: 164708 - DNA, 2957 bp, Homo sapiens
  Payload ID: 12447
  Gene Symbol: PHF12
  Gene Name: PHD finger protein 12
  Uniprot ID: Q96QT6
  ENST ID: ENST00000268756
  CDS Start-End: 531-2645
cgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcaggtgagtgctgctcagccttgggttgatttggaataattttatgctctttctggcaaataagattctaaaagcacttatatccctgtgaatacttcagaggactttggcctttgtattgtttgtcttactctcatttccgtaatagaagaggaagcacatgttaacttgtcccgtttataaatgggactgcttaggctctgaaagcttcagtgatttccttaaaatgacctactgagtcagtggcaggattggaaccacagcccaggtctcctgactccatcccataccttccaggcctaggcctctgcctgttttgttctgtcaccttaaaagaaggc

SEQ ID NO: 164709 - DNA, 4759 bp, Homo sapiens
  Payload ID: 12447
  Gene Symbol: PHF12
  Gene Name: PHD finger protein 12
  Uniprot ID: Q96QT6
  ENST ID: ENST00000332830
  CDS Start-End: 812-3826
cttagtttgcacacaaacaccaatggatgaacagtccctagcttcctgcggctgcgccttgacccctacaagctttctcaagcgcctgcgcgagacctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaa

SEQ ID NO: 164710 - DNA, 2963 bp, Homo sapiens
  Payload ID: 12447
  Gene Symbol: PHF12
  Gene Name: PHD finger protein 12
  ENST ID: ENST00000378879
  CDS Start-End: 398-2515
acaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagctctaggagttccagagcctatgggttgagaatcaagaagggaacatcaccttggatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaaggtgcgcatgtacacacctgtcaccacatcatcagatctcccctctacgtgtgcgaatggtcaccttgcctccatggagaatctgagcttccagtatctcaaacctccttgtgtgcttttcatgggcttaataaagcaccatggtttttttct

SEQ ID NO: 164711 - DNA, 1875 bp, Homo sapiens
  Payload ID: 12447
  Gene Symbol: PHF12
  Gene Name: PHD finger protein 12
  ENST ID: ENST00000583524
  CDS Start-End: 812-1201
cttagtttgcacacaaacaccaatggatgaacagtccctagcttcctgcggctgcgccttgacccctacaagctttctcaagcgcctgcgcgagacctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagaca

SEQ ID NO: 164712 - DNA, 649 bp, Homo sapiens
  Payload ID: 12447
  Gene Symbol: PHF12
  Gene Name: PHD finger protein 12
  ENST ID: ENST00000584685
  CDS Start-End: 3-649
gaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcgcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatga

SEQ ID NO: 164713 - DNA, 7679 bp, Homo sapiens
  Payload ID: 12447
  Gene Symbol: PHF12
  Gene Name: PHD finger protein 12
  Uniprot ID: Q96QT6
  ENST ID: ENST00000577226
  CDS Start-End: 348-2897
tggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaaggtgcgcatgtacacacctgtcaccacatcatcagatctcccctctacgtgtgcgaatggtcaccttgcctccatggagaatctgagcttccagtatctcaaacctccttgtgtgcttttcatgggcttaataaagcaccatggtttttttctgaagagagcaggaacaagatggcaaccacagctttctgatcagacttggggaagtctgctgtaactttctttcatatataagtccacttcgagacacagcaaagcagctaccagtacctttgggtatatgtagtgtactttctgcttacttgctttcaaatatttgaattagaagggcttcccgactgagtgcagtggctcacacctgtaatcccagcactttgggaggctgaggcgggaggatcacttgagcccaggagttggagaccagcctgggcaacacagtgagaccctatctctacaaataattttaaacttacccaggcatggtggcatacacctgtaatcccagctgcttggaaggctaagatgggaggatcgcttgagtctgggaggtcaaggctgcagtgagctatgattgtgccactgcactccagcctgggtgacagagtgagaccctgtctccaaataaataagtaaataaataaataaaattttaaaaagaatggcttcccaagagggaacttttcaagttcaagttgagaaatagaataacactaggccaaccttctggaaattttccccaagtggttaactctgtttcagatatgtctgagcattggccattaagagccttgctgcttcaaagtgtggttcgcagaccagcagcatcagcagcccctgagagcttgttagaaatgcagagctcaatgcattggttttttgcctatttttaaagaaaacagcaaaagaaatgcagagctaaggcccctcctcagacctattgaatcagaatctgcatttcaacaagatctgtaggcgattcttatgcacattaaagtttgagaaacactggtccatgccgtctgtttttccatattctccctatagtaccagctggaatatcccggattagccagccaggagcccaggaacttacacagtactgtcatctctgacttctctgaccatcttcaaagatggtcctctgtaccctgtgttggaaatgctgtgggtggggagagaaagccttaccctgccgcagctcagtgttggatgtgagtttggaaagatgagtcatccagcgggattttctccaggccatgagccaaaggtccagattttgttggtttatgtttggatcacaggatctgagtttctgaatgatcctattcctatgtttgtcttgtagtgcaaagaaaggaggtacaggcccgagctgtgttctaccccctcttagggttgggaggagctgtgaacatgtgctatcgaaccctctacatcgggacaggtgagccagccaggaagctgggagagacactgaatctgttcagccctaaagactgacacccttacccacagaagttagaaaggggtgagggaagccctttccagagttgactgctttaaatcagtggatagctagacaagagaaactaagaatagagacaatcagccagtcacggtggctcacgcctataatcccaacactttgggaggacaaggcaggaggaacacttgagcccaggacttcgagaccagcctgggcaacatggtgaaaccctatctctaccaaaaacaaatataaaaaattagctgggctaacatgcctatagtcccagctacttgggaggctgaggtgggaagatcacctgaggctgggaggtccaggcagtgatcctttttgtgcctctgcactccagcccaggcaacagagtgagaccctgtctcaaaaataaaagagacaatcagttccttgtcttcccttgttcaggcccttttgctttgtctttgcccagtgttgcaacagcagagatgaaagtcagctctgactactgcccagggaggcactttaaacactgcagggaagaacctaaggagaaggcagatgctttgtccctggtggtctttgaaagagtgatagactcacacatacccaatcttcagttagccctgtatctgttttttgttttgttttgttttccctaaaagtcctagagaccgatagctctgtatctggtacagaaggacagacagattagcccttaccctagaaacttccctttctttaaggtgataagattttctaggctctgcaccccgatgttgtattttcatagaaatatcccatcctcttcagtagctcactcttcccttctgggtagcagccacatgttctaaagcagatcagctggcagggacagctgttctttatcaggagcttggaaaagacaacagtttttgttcaaaaataaaaggggagggccctgagctactcacccttgaagtctctgctagtgccaacccagaagctaactctctccctgtcttacctccccgacacatgcaccttacaatctgttctctgccttccttttcctctactcctgccaccttgcaggagctgacatggatgtgtgccttacaaactatggtcactgtaactacgtgtccgggaaacatgcctgcatattctacgatgaggtgagggccggagatgcggtgggagggagctttcccaacctgaggcctctcccaggcagtaggtttttgttcagtgccctgaggggagggaagagggattgggggtcctctctttttcttccctccctgtcattcctggaggaggagagtcttgatgtgaaatagcatcctacctgggaagctacctgcttcccaggagcagggctaccatttttcctgaggttagtcacaggcacaacagagggagcctaccctaaagcaagggaggggaccagcatagaaggaagccaagccttgtgggtgtgtccctgtgaatttcattatcatcacgggccagtgagtatcataccaagaggagcggtgctgagagggcagagtgaaggagtgggagagtagggagtgtgggacaccagaaggaaagcttccctgaggaggtgtctccagcccccttctgaaaggacaggggccatgactggggaggcaagtaaggactctctaggtagagtagcacggccttctccatatgtcctctctccccttagccccaggccccacacagcagaccacacatcttatctcccctcctcctcctcagaataccaaacattatgagctgttaaactacagtgagcatgggacaacggtggacaatgtgctgtattcatgtgacttctcggagaagaccccgccaacccccccaagcagtattgttgccaaagtgcagagtgtcatcagtaagttggagcagagatctgtggccacaaagctgaggccccagtcagggtggttctgacttgctgcccatggtctgtctcttgccttcccagtcctattggccaagctctacttcctcgtgggcccagggcaggccacagagaagcaagtgctgagtacccccatgtgtgtacacacctgtggggacttcagactccaccaaccctttctgagcatccttcctccctagtcatgcagcagttggaatggggagatgcaggagcccaaccttggcaaacagcccacatgggttggctgctcactgttcctcttctgtgaccatccccctttttcccagggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttc

SEQ ID NO: 164714 - DNA, 869 bp, Homo sapiens
  Payload ID: 12447
  Gene Symbol: PHF12
  Gene Name: PHD finger protein 12
  ENST ID: ENST00000589176
  CDS Start-End: 1-241
gtttgatcgtttccaggacaccgtttcgcagcatgtcgtcaaagtggacttcctgaaccgaatccacaagaagcacccccctaaccggcgttgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagccc

SEQ ID NO: 164715 - DNA, 560 bp, Homo sapiens
  Payload ID: 12447
  Gene Symbol: PHF12
  Gene Name: PHD finger protein 12
  ENST ID: ENST00000584822
  CDS Start-End: 1-164
agttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacagctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattggg

SEQ ID NO: 164716 - DNA, 555 bp, Homo sapiens
  Payload ID: 12447
  Gene Symbol: PHF12
  Gene Name: PHD finger protein 12
  ENST ID: ENST00000584236
  CDS Start-End: 466-555
attcgctctcccgaggcgccagcccactccatctcgttgcaccggcaggcctccccacccccttcttgttggcccctttgtgcttcccccagcacgtccgggtaccgggctttgggcctctcccgagcgggtctttggagtcccccactgtccatacaaggaagtggcaagaagggaaccgcgcaccctcttcccatccccctacccttgatcctccccatttggaagaagctgttctcgttgttgtgctgcaggaacgcgcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatgga

SEQ ID NO: 164717 - DNA, 555 bp, Homo sapiens
  Payload ID: 12447
  Gene Symbol: PHF12
  Gene Name: PHD finger protein 12
  ENST ID: ENST00000582853
  CDS Start-End: 280-555
gaggtgggggttgggacgagtgaagagaaccccatatgggattggaagtcgctggggagccgggacagagccggccggggacagccggcagtggcgggggaggaaggggaggagctccgggcccagtgccgcttgcctgcccgcgcgcccgctgccctcggggctcctgcccggccgggatctcctcggggttcaagtgattctcctgccttacgtgtcatgttgtcttactggtccacctaaatatggaagatacgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgat

SEQ ID NO: 164718 - DNA, 820 bp, Homo sapiens
  Payload ID: 12447
  Gene Symbol: PHF12
  Gene Name: PHD finger protein 12
  ENST ID: ENST00000579036
  CDS Start-End: 1-820
cccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaag

SEQ ID NO: 164719 - DNA, 648 bp, Homo sapiens
  Payload ID: 12447
  Gene Symbol: PHF12
  Gene Name: PHD finger protein 12
  ENST ID: ENST00000583747
  CDS Start-End: 297-648
agcccactccatctcgttgcaccggcaggcctccccacccccttcttgttggcccctttgtgcttcccccagcacgtccgggtaccgggctttgggcctctcccgagcgggtctttggagtcccccactgtccatacaaggaagtggcaagaagggaaccgcgcaccctcttcccatccccctacccttgatcctccccatttggaagaagctgttctcgttgttgtgctgcaggaacgcggttagggtgggctccccctggttccgggggctgagagattctgggagcagcctggatgggaggaagaaggacaaaaggggggagaggggtgggtgacggagaaaccgcgccgggggggcgacggaccgcccgggagctccgagtgtgcacacacgccgtttgtatgtgtgtgcagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtc

SEQ ID NO: 164720 - DNA, 574 bp, Homo sapiens
  Payload ID: 12447
  Gene Symbol: PHF12
  Gene Name: PHD finger protein 12
  ENST ID: ENST00000578900
  CDS Start-End: 116-574
agttctgagggttgcctgggctctgctgggtggtttttctgtttcacatgatgttggctgggactgcagtcatttggaggcttcactgaactgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagagg

SEQ ID NO: 164721 - DNA, 3681 bp, Homo sapiens
  Payload ID: 12448
  Gene Symbol: PHF13
  Gene Name: PHD finger protein 13
  Uniprot ID: Q86YI8
  ENST ID: ENST00000377648
  CDS Start-End: 383-1285
agtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatgattcaaggttcaggcgattgcgttctgtgctgaagga

SEQ ID NO: 164722 - DNA, 4276 bp, Homo sapiens
  Payload ID: 12449
  Gene Symbol: PHF14
  Gene Name: PHD finger protein 14
  Uniprot ID: O94880
  ENST ID: ENST00000403050
  CDS Start-End: 453-3119
acttccttttcagagctgtatccgggtcgctgctttccctattgtctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaaaggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcgtctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcagatacccttcatgagacccaactctgccacagctcatcctcggaggcaatcccggaaacctcttttataagtgtgattttaaaaatgtggattaaactctcgatagagtacataaagtaaaggagaacagctatattgtcctttctataagcttgtcactgcaaaaagttgccttttgcttgtcaggtttggatagaatataattgattggtttgttacttggactaacaaggcagtagatttgcctgtgtggaattttttttcctatttttcttctttttgctttttttgcacttatcagaaatatttgatgtgtgcattgttgaaaaatactggatacatgtcttgtcagaattgtcgtattaagtaatgtctttccctcttgcttctttggcaaatgttgatacacagtgtttggacttactgaagagttactgaagcctgtgggacttaataaatacaatatgctactccctgttgtgattgaacaatacaaataacaaacaagaaagacaatgcattccattagtctgctattctgtttccttcaacttcatacatagattcatatatgaagtactgcattgtaaaacaactatagactcatattaaatgttatttctatttataatattcagcaaaagtgaaagacttgtgaagcatatgacattctatttttgacttattagtcctagtgtgaaagcattaatattattagcatgaaatttttacttcagattttaagctcatgaataaagatatatctgtgttgatctctagatatttttagtaatacccaaatatattcagtccttattgttttaatataagctttctgtgttcagtataattttatttttctcaaccttaaatatgaacttaggaaataaggagggaagtacaaagattattgactatacaacctaccagctgaaagaaagatcttcatcaacatctgtatctttccagaggtatacagaattaaaatttgatcttcaagctttaatgatccagttttaagtcaacggcagaagtatgttgaatatttcatcactcaatcttgaactgatttagaagagactctttgctgaaattgaattgcacttatacatgtaaattgtcaacatgtaatttggaattttctgattaataaatgtggttttggacatct

SEQ ID NO: 164723 - DNA, 2627 bp, Homo sapiens
  Payload ID: 12449
  Gene Symbol: PHF14
  Gene Name: PHD finger protein 14
  ENST ID: ENST00000423760
  CDS Start-End: 436-564
gtatccgggtcgctgctttccctattgtctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaatagga

SEQ ID NO: 164724 - DNA, 2479 bp, Homo sapiens
  Payload ID: 12449
  Gene Symbol: PHF14
  Gene Name: PHD finger protein 14
  ENST ID: ENST00000521747
  CDS Start-End: 453-581
acttccttttcagagctgtatccgggtcgctgctttccctattgtctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcagatacccttcatgagacccaactctgccacagctcatcctcggaggcaatcccggaaacctcttttataagtgtgattttaaaaatgtggattaaactctcgatagagtacataaagtaaaggagaacagctatattgtcctttctataagcttgtcactgc

SEQ ID NO: 164725 - DNA, 3407 bp, Homo sapiens
  Payload ID: 12449
  Gene Symbol: PHF14
  Gene Name: PHD finger protein 14
  ENST ID: ENST00000634607
  CDS Start-End: 421-3267
ctttccctattgtctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaaaggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcgtctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgta

SEQ ID NO: 164726 - DNA, 836 bp, Homo sapiens
  Payload ID: 12450
  Gene Symbol: PHF19
  Gene Name: PHD finger protein 19
  Uniprot ID: Q5T6S3
  ENST ID: ENST00000312189
  CDS Start-End: 114-737
actcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaa

SEQ ID NO: 164727 - DNA, 4241 bp, Homo sapiens
  Payload ID: 12450
  Gene Symbol: PHF19
  Gene Name: PHD finger protein 19
  Uniprot ID: Q5T6S3
  ENST ID: ENST00000373896
  CDS Start-End: 254-1996
gaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagtta

SEQ ID NO: 164728 - DNA, 565 bp, Homo sapiens
  Payload ID: 12450
  Gene Symbol: PHF19
  Gene Name: PHD finger protein 19
  ENST ID: ENST00000453868
  CDS Start-End: 45-565
gttgcgaccgcccaagcagggccccagggagatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaatt

SEQ ID NO: 164729 - DNA, 888 bp, Homo sapiens
  Payload ID: 12450
  Gene Symbol: PHF19
  Gene Name: PHD finger protein 19
  ENST ID: ENST00000456291
  CDS Start-End: 569-888
cgcccggccagggtggaggcgggtgcggcgacccggccggctcctagaggcgcagcgggagaggaagtgtcagtttgtgaacctgcagcggccccggcctggcccctggccgggcgggcggggacctcgcagcgccgggcgagccaggtggcagggagaggacagggattcagaccgcatcccctgcccgggagcctgtgcgctctgcgctggagaaaaaggagatgggagtgggggtggagaaggtcgtggccacgccaccatctggggagccgagacccctgcagtgcctggctcgccccagggccccgcacatacttagcttcacacactccctggcacaatgccgtagacatcatcctgcccagtctcacaggagtacacacacgcaccacacagaaacaggcactggactctctccctgtgaacagatagtcacaacaccaggtgcccagcgccatggccacaaggaggagacccgagtaggcccgcggggaaagagagaggctgtgtgtggctgtagtggagagcatgtggagggacttggagccagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatc

SEQ ID NO: 164730 - DNA, 556 bp, Homo sapiens
  Payload ID: 12450
  Gene Symbol: PHF19
  Gene Name: PHD finger protein 19
  ENST ID: ENST00000439674
  CDS Start-End: 377-556
agcactgtggagcagggctggagggcagaggtgttaccttggagctttgtaggaaacgaggaagtattgaagagtggttaagagcctgggccggacacagtgcgaatcctcccaggacgtccacgtcctagctctgctccttaccagctgtgcaaccccttagcctcagctctctgaatagtttccccatcatgtggtgattatgagcagagcatgaattacgtaattcacatagaggttctcatagtgcctggcatttggtaaacaaaaaaaatgtgagctgttactggtggtagtggtggtactaatgcatgaaagtcaagataaccttttcacagtcagagtcagtggaaccggctgctgatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctat

SEQ ID NO: 164731 - DNA, 3525 bp, Homo sapiens
  Payload ID: 12450
  Gene Symbol: PHF19
  Gene Name: PHD finger protein 19
  ENST ID: ENST00000419155
  CDS Start-End: 118-1233
gagggcggggcctcggggggcgggcccggaaggttagaccttggggcgaggcctcgggaggcgggcctggcgggttgcgaccgcccaagcagggccccagggagatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatc

SEQ ID NO: 164732 - DNA, 558 bp, Homo sapiens
  Payload ID: 12450
  Gene Symbol: PHF19
  Gene Name: PHD finger protein 19
  ENST ID: ENST00000436309
  CDS Start-End: 62-558
ttttcgaaatctccctgaactttggcggcccgaacgcctccgggggtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgc

SEQ ID NO: 164733 - DNA, 4159 bp, Homo sapiens
  Payload ID: 12450
  Gene Symbol: PHF19
  Gene Name: PHD finger protein 19
  ENST ID: ENST00000616568
  CDS Start-End: 68-1867
accagtaagtcgtgtatttagcattcattcatcaaagcctccggatgcctcctacgtgccctgcactatgctggtcttggtaatccgtggtccctatcccagcgcccagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatc

SEQ ID NO: 164734 - DNA, 5569 bp, Homo sapiens
  Payload ID: 12451
  Gene Symbol: PHF2
  Gene Name: PHD finger protein 2
  Uniprot ID: O75151
  ENST ID: ENST00000359246
  CDS Start-End: 368-3658
ggccgctcggcggccgggggtcccttcggtggggccgcggctccccgcccgccgcccccgcgcgtccattcccttttgtgtcccgcgcgcggcccgtcccccgcgcacactagcgccctgagccccgcgggccggcgggcggctcccggcgcggcccctccagccagcgcgcccggcattgtgtggacgcgcctggccgggagcgcgcgcgggggctgtcgtgcgcccccgtccccgtcccctcccggccgcggcgccgcctgcgccccgccgcccccgccgcccccgcgcggcccggcccccggcccggcccggaccgacccgggcagcgcagcggcggggccgagcggcggcgcggcgcggcaacatggcgacggtgcccgtgtactgcgtctgccggctcccctacgacgttacccgcttcatgatcgagtgcgacgcctgcaaggactggttccacggcagctgtgttggggtggaagaggaggaggcgcccgacatcgacatataccactgcccaaactgtgagaaaacccatgggaagtccaccttaaagaagaagcggacctggcacaaacacggcccggggcaagcgcctgacgtcaagcccgtgcagaatggcagccagctcttcatcaaggagctgcggagccggacctttcccagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacagaa

SEQ ID NO: 164735 - DNA, 3045 bp, Homo sapiens
  Payload ID: 12451
  Gene Symbol: PHF2
  Gene Name: PHD finger protein 2
  ENST ID: ENST00000375376
  CDS Start-End: 205-1134
gtgcgcccccgtccccgtcccctcccggccgcggcgccgcctgcgccccgccgcccccgccgcccccgcgcggcccggcccccggcccggcccggaccgacccgggcagcgcagcggcggggccgagcggcggcgcggcgcggcaacatggcgacggtgcccgtgtactgcgtctgccggctcccctacgacgttacccgcttcatgatcgagtgcgacgcctgcaaggactggttccacggcagctgtgttggggtggaagaggaggaggcgcccgacatcgacatataccactgcccaaactgtgagaaaacccatgggaagtccaccttaaagaagaagcggacctggcacaaacacggcccggggcaagcgcctgacgtcaagccccccaaaaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacagaa

SEQ ID NO: 164736 - DNA, 2921 bp, Homo sapiens
  Payload ID: 12451
  Gene Symbol: PHF2
  Gene Name: PHD finger protein 2
  ENST ID: ENST00000610682
  CDS Start-End: 28-1014
ggccgagcggcggcgcggcgcggcaacatggcgacggtgcccgtgtactgcgtctgccggctcccctacgacgttacccgcttcatgatcgagtgcgacgcctgcaaggactggttccacggcagctgtgttggggtggaagaggaggaggcgcccgacatcgacatataccactgcccaaactgtgagaaaacccatgggaagtccaccttaaagaagaagcggacctggcacaaacacggcccggggcaagcgcctgacgtcaaggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtac

SEQ ID NO: 164737 - DNA, 1997 bp, Homo sapiens
  Payload ID: 12452
  Gene Symbol: PHF20
  Gene Name: PHD finger protein 20
  ENST ID: ENST00000339089
  CDS Start-End: 369-1997
agagtccttctgtcggttggtcctggagcggcgcagccggagtggggccgtgaggctggaatgcagtgacatcatctcagagctgactgcaacctctgcctcctggattcaagcaattctcctgcctcagcctcccgagtagctaggattacaggcggatgccaccatgcccggctaatttttgtatttttggaagagatgggttttcaccatattcgccaagctagtcttgaactcctgacctcaagtgatccactctcctcggcctcccaaagtgctaggattacaggccactgtgcctggccaagaggtcacttttcatgtccaggctgcatggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaag

SEQ ID NO: 164738 - DNA, 1814 bp, Homo sapiens
  Payload ID: 12452
  Gene Symbol: PHF20
  Gene Name: PHD finger protein 20
  ENST ID: ENST00000374000
  CDS Start-End: 167-1814
agagtccttctgtcggttggtcctggagcggcgcagccggagtggggccgtgagcacgagtacacgagacaggattgagaaaggagagattcaaattgtgacttcagattcaaaggcaattaaaggaattaaacgagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaaga

SEQ ID NO: 164739 - DNA, 5922 bp, Homo sapiens
  Payload ID: 12452
  Gene Symbol: PHF20
  Gene Name: PHD finger protein 20
  Uniprot ID: Q9BVI0
  ENST ID: ENST00000374012
  CDS Start-End: 130-3168
atacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagtta

SEQ ID NO: 164740 - DNA, 539 bp, Homo sapiens
  Payload ID: 12452
  Gene Symbol: PHF20
  Gene Name: PHD finger protein 20
  ENST ID: ENST00000449988
  CDS Start-End: 77-539
aaaacaaaagaagacctgcttcaaagtagaatgaagtaggtgctgaaatagagctaccaggaggaggcagggcaggatggtgcaggttaatcatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggca

SEQ ID NO: 164741 - DNA, 832 bp, Homo sapiens
  Payload ID: 12452
  Gene Symbol: PHF20
  Gene Name: PHD finger protein 20
  ENST ID: ENST00000452270
  CDS Start-End: 373-684
acgcagagtccttctgtcggttggtcctggagcggcgcagccggagtggggccgtgaggctggaatgcagtgacatcatctcagagctgactgcaacctctgcctcctggattcaagcaattctcctgcctcagcctcccgagtagctaggattacaggcggatgccaccatgcccggctaatttttgtatttttggaagagatgggttttcaccatattcgccaagctagtcttgaactcctgacctcaagtgatccactctcctcggcctcccaaagtgctaggattacaggccactgtgcctggccaagaggtcacttttcatgtccaggctgcatggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctagacgttttcttgctctgtcgcccagtctgaagtgcagtggtgcagtcttggcttaatgtagccttgacctcttgggctcaagcaatcctccttcctcagcctcctgagtacctgggactataggaatttcaaataaatgagcaggtccttgcttgctggtctgattgtcgtttttacccggccaaagtcactgctgttaacaag

SEQ ID NO: 164742 - DNA, 2032 bp, Homo sapiens
  Payload ID: 12452
  Gene Symbol: PHF20
  Gene Name: PHD finger protein 20
  ENST ID: ENST00000439301
  CDS Start-End: 34-1950
ggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgcaccaacccagatgaggaacttgatggggatgaccgctatgacttcgaggtggtccgctgcatctgtgaggtccaggaggaaaatgacttcatgatt

SEQ ID NO: 164743 - DNA, 384 bp, Homo sapiens
  Payload ID: 12452
  Gene Symbol: PHF20
  Gene Name: PHD finger protein 20
  ENST ID: ENST00000420233
  CDS Start-End: 193-384
ggttcatggggagttgtagctcctctgccactgagttctatgatcttgagtagccactgccgttgggcttcattctctcagtgaaatgaggaagtggagttgagttcactgccaggcagcatgcttcgtttgggctgttactaaatgacagatccaaggacagattggcatcctcgtttccttgccctatgaatgttcttgtttggagaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgatt

SEQ ID NO: 164744 - DNA, 3297 bp, Homo sapiens
  Payload ID: 12453
  Gene Symbol: PHF20L1
  Gene Name: PHD finger protein 20-like 1
  ENST ID: ENST00000220847
  CDS Start-End: 322-3297
gctgacgtcgccggggcccggcgtcgcgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatga

SEQ ID NO: 164745 - DNA, 2311 bp, Homo sapiens
  Payload ID: 12453
  Gene Symbol: PHF20L1
  Gene Name: PHD finger protein 20-like 1
  Uniprot ID: A8MW92
  ENST ID: ENST00000337920
  CDS Start-End: 272-1129
gcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtattacttttctttattagtagcctaataaagaagactttgagtatcttttgctctcctctagatgcgttttaaaaactattccaaatttaattgatattgtattgagtttttcagggttattttaggcctgatttgataacaatgcgttgttttggtgcctccattaatgttgtattaaatcaatgggtcttttaaattgattaatatgtcattgaatcataccttctgattttctgtgatcatccaacggttaagtctttgccgttattgtcaatatatcaaccaaattttaaataactttttttactgtgtattactatattcaacgtcccagatataacaatattttgtattttcaccactgtttatggtattctcagaatgcgataaatcagggacttgggtaataaaatgtttctggaaaattca

SEQ ID NO: 164746 - DNA, 2236 bp, Homo sapiens
  Payload ID: 12453
  Gene Symbol: PHF20L1
  Gene Name: PHD finger protein 20-like 1
  ENST ID: ENST00000395376
  CDS Start-End: 104-1054
cgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcagtttctgttccaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttgtaggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtattacttttctttattagtagcctaataaagaagactttgagtatcttttgctctcctctagatgcgttttaaaaactattccaaatttaattgatattgtattgagtttttcagggttattttaggcctgatttgataacaatgcgttgttttggtgcctccattaatgttgtattaaatcaatgggtcttttaaattgattaatatgtcattgaatcataccttctgattttctgtgatcatccaacggttaagtctttgccgttattgtcaatatatcaaccaaattttaaataactttttttactgtgtattactatattcaacgtcccagatataacaatattttgtattttcaccactgtttatggtattctcagaatgcgataaatcagggacttgggtaataaaatgtttctggaaaattca

SEQ ID NO: 164747 - DNA, 1998 bp, Homo sapiens
  Payload ID: 12453
  Gene Symbol: PHF20L1
  Gene Name: PHD finger protein 20-like 1
  ENST ID: ENST00000395379
  CDS Start-End: 309-1244
ccggcgtcgcgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtat

SEQ ID NO: 164748 - DNA, 6237 bp, Homo sapiens
  Payload ID: 12453
  Gene Symbol: PHF20L1
  Gene Name: PHD finger protein 20-like 1
  Uniprot ID: A8MW92
  ENST ID: ENST00000395386
  CDS Start-End: 300-3353
cgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgcaaaacagtcagaaatttttattgccttttgagattctccaacttgacaaatgtgccaaagatcaacagacagaaaatatcatcctgtgtatttacttgtcatactttaactttgtgaaagatcttactgataaatgaaaagctttagcagaggtggtattgtggggtaattgcttaaatttacatatcaaagtaaaaaagtagtgcctgtattccatgtgtggagtaaatttgctaatgtctatattttatgattgatactattatttttcctttgcattttaaaatagtggctctaatattttccctgtcatggctacattctagacattgaatttatatcttctttttttcagatacggagcaaatagcatccttaacctatgaataatggtgttgcctagattcttgtcacacacacagaagaccctttgtacctagtaacattcatcctcttgattcctggtgaacacggttaaattcatgcacatttgttcttgtagtttctaaaaattagatcaatttatttgttagccagcaaattgaaaattccattattagattaatgaaatttttgctctgcttatatgtatacgaactggaaatctgaatttttaaatttagatctttaaatcaaattatttttatgcatattttcatttaatatagagtataccaatcgattgaagcctttcacaagtagtgcgctgagcttttcttattgaagagagtgaattagtttctgagaagtcagtctattgtgaaaagtttcagatgagattattttcttttagtctttttaaatatcactatatgtatttaaatagaagcaataaactagagagagtgtttcttgaaaagacaatgttttatttgccaccaggcagaacagaatgagcattggtagagaaggctccctcttggtatgttactgataaacttgtacttcctcatacttgtttgtggttctactgacttatttccaaacttaagagtaatgtacttcgaaaacaacttggttattctttaaatttcaggtaaaaccccttttcctaacactcatcttatttccactgtcttatttcctctcagatgttcatatttcacatgttcaaaatgaagcgtactatttcccctccaataaacgaagtctcctgccaa

SEQ ID NO: 164749 - DNA, 5900 bp, Homo sapiens
  Payload ID: 12453
  Gene Symbol: PHF20L1
  Gene Name: PHD finger protein 20-like 1
  ENST ID: ENST00000395390
  CDS Start-End: 38-3016
gtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttgtaggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgcaaaacagtcagaaatttttattgccttttgagattctccaacttgacaaatgtgccaaagatcaacagacagaaaatatcatcctgtgtatttacttgtcatactttaactttgtgaaagatcttactgataaatgaaaagctttagcagaggtggtattgtggggtaattgcttaaatttacatatcaaagtaaaaaagtagtgcctgtattccatgtgtggagtaaatttgctaatgtctatattttatgattgatactattatttttcctttgcattttaaaatagtggctctaatattttccctgtcatggctacattctagacattgaatttatatcttctttttttcagatacggagcaaatagcatccttaacctatgaataatggtgttgcctagattcttgtcacacacacagaagaccctttgtacctagtaacattcatcctcttgattcctggtgaacacggttaaattcatgcacatttgttcttgtagtttctaaaaattagatcaatttatttgttagccagcaaattgaaaattccattattagattaatgaaatttttgctctgcttatatgtatacgaactggaaatctgaatttttaaatttagatctttaaatcaaattatttttatgcatattttcatttaatatagagtataccaatcgattgaagcctttcacaagtagtgcgctgagcttttcttattgaagagagtgaattagtttctgagaagtcagtctattgtgaaaagtttcagatgagattattttcttttagtctttttaaatatcactatatgtatttaaatagaagcaataaactagagagagtgtttcttgaaaagacaatgttttatttgccaccaggcagaacagaatgagcattggtagagaaggctccctcttggtatgttactgataaacttgtacttcctcatacttgtttgtggttctactgacttatttccaaacttaagagtaatgtacttcgaaaacaacttggttattctttaaatttcaggtaaaaccccttttcctaacactcatcttatttccactgtcttatttcctctcagatgttcatatttcacatgttcaaaatgaagcgtactatttcccctccaataaacgaagtctcctgccaa

SEQ ID NO: 164750 - DNA, 621 bp, Homo sapiens
  Payload ID: 12453
  Gene Symbol: PHF20L1
  Gene Name: PHD finger protein 20-like 1
  ENST ID: ENST00000522580
  CDS Start-End: 363-621
gaggtagtgaaaagagaatactgaagaataggatctcaagatgagtaaaaagcccccaaatcgccctggaatcacttttgagattggtgctcgtttggaggcactggactacttacaaaaatggataatgaagcgctgacagtttgagttaataaatcatcttgtctttcaaaagtttttggttttgtgaatgtggaccactttgaaaatctgattaaacttgggaattctcacctcaaaagaatacccatatacatctacaccaagcacatagcattttgcatgcagcctcagggaattcagtctcctgatctagtgggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaa

SEQ ID NO: 164751 - DNA, 427 bp, Homo sapiens
  Payload ID: 12453
  Gene Symbol: PHF20L1
  Gene Name: PHD finger protein 20-like 1
  ENST ID: ENST00000521038
  CDS Start-End: 1-338
ctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttgataaactctcatatatgtgttctgttgaaagtaggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctg

SEQ ID NO: 164752 - DNA, 1633 bp, Homo sapiens
  Payload ID: 12453
  Gene Symbol: PHF20L1
  Gene Name: PHD finger protein 20-like 1
  ENST ID: ENST00000486199
  CDS Start-End: 7-801
ctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggaagagaccagctgtgtattttatagctaatatagaatactggaaggttgtaactttattggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactatgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtaagagaaaagaaaaagataaggaaagaagagagaagagagacaaagatcactacagaccaaaacagaagaag

SEQ ID NO: 164753 - DNA, 3393 bp, Homo sapiens
  Payload ID: 12453
  Gene Symbol: PHF20L1
  Gene Name: PHD finger protein 20-like 1
  ENST ID: ENST00000460236
  CDS Start-End: 1-281
cagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccac

SEQ ID NO: 164754 - DNA, 3375 bp, Homo sapiens
  Payload ID: 12453
  Gene Symbol: PHF20L1
  Gene Name: PHD finger protein 20-like 1
  Uniprot ID: A8MW92
  ENST ID: ENST00000622263
  CDS Start-End: 322-3375
gctgacgtcgccggggcccggcgtcgcgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatga

SEQ ID NO: 164755 - DNA, 1810 bp, Homo sapiens
  Payload ID: 12453
  Gene Symbol: PHF20L1
  Gene Name: PHD finger protein 20-like 1
  ENST ID: ENST00000485595
  CDS Start-End: 282-764
ggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtaagagtgttcagtattcctagctacccaaagggttatcttcttgaacggtgactgatcaaaatatatttatatgtatattttttaaaaatgaactaattgtagggttatgtgctgatagccccaaatagcagcaagaaaaggaagcttagactgtaaaataaattatacatttgatttttgcttctttggtttagacctgctaaagttataggtcactagtttctgttccaggtgaaatcccagcatccactaagctggtgttgtcctatcgacccagctggatcgtgtaaccagtctatgggaagtgaggtaagagccttttttttaaaaattttgttttgtttttcctggtatataatgtcatttagaaagttaaaaatttttaatataaaaatttacattgagttcttatcttcttctttccttctacaaatcatagtcattcatcttcctttaaaaggcgcttacctgacactctgtaggctgtttcagatagggctctctgagtcatgtgatggaagcagtgtattgtatgctttgtcactgctcaaagcaagaatggatggtaagcattggaaggagaatcttgggtggaggtaaaaaccacaattccatttgttggctatgttttctgaaatactggaaagaaaggtgccattagaaatttaaaatattttcttttctattctgctgttatttgggattttcagcacctggacctacaattaattttaagaaattgaaagtagtgtgtaaaaatgtctaatatggaaatatgctacgtatttgttccataccatgcggtgaaaactgtcattctgaaatgtattgaaattacctggtcagcttcagtcaagtgtaaacatttagtgctctagaaatgtatatctaccacattaaaaaaattattcatgaagaaataagtgtgattgttttaaattgcctggttttcaaaaatttagttatgaaatgattagcaagcagatttcttctaattaatatgtaaatgcaatttaaaatgaaaatgcttttgatcaggaagtggctttgtgtcttcccacatgtatgtataaataaagtgttcttttaagcattca

SEQ ID NO: 164756 - DNA, 3675 bp, Homo sapiens
  Payload ID: 12454
  Gene Symbol: PHF21A
  Gene Name: PHD finger protein 21A
  Uniprot ID: Q96BD5
  ENST ID: ENST00000323180
  CDS Start-End: 369-2273
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactgg

SEQ ID NO: 164757 - DNA, 2730 bp, Homo sapiens
  Payload ID: 12454
  Gene Symbol: PHF21A
  Gene Name: PHD finger protein 21A
  Uniprot ID: Q96BD5
  ENST ID: ENST00000418153
  CDS Start-End: 201-2243
cctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaa

SEQ ID NO: 164758 - DNA, 555 bp, Homo sapiens
  Payload ID: 12454
  Gene Symbol: PHF21A
  Gene Name: PHD finger protein 21A
  ENST ID: ENST00000524497
  CDS Start-End: 154-555
aggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagatattttttctttccaatcagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttct

SEQ ID NO: 164759 - DNA, 451 bp, Homo sapiens
  Payload ID: 12454
  Gene Symbol: PHF21A
  Gene Name: PHD finger protein 21A
  ENST ID: ENST00000532028
  CDS Start-End: 1-451
gtgtccctgcccagccccacctccacagacatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagg

SEQ ID NO: 164760 - DNA, 550 bp, Homo sapiens
  Payload ID: 12454
  Gene Symbol: PHF21A
  Gene Name: PHD finger protein 21A
  ENST ID: ENST00000525676
  CDS Start-End: 1-280
tgcctacaaagcagcaaaagaagaagagaaacagaagttacttaaatggagttcagatttaaaacaagaacgagaacaactagagcaaaaggtgaaacagctcagcaattccataagttgtgaggaagcgggctttctagagacaagtattggaaaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgc

SEQ ID NO: 164761 - DNA, 1051 bp, Homo sapiens
  Payload ID: 12454
  Gene Symbol: PHF21A
  Gene Name: PHD finger protein 21A
  ENST ID: ENST00000532883
  CDS Start-End: 365-613
ttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattggtttctttactgcaggacttctcagaacctttaatatgctaatgtgcattgtgaatctccaagagggggatatgatatgcagcattcttgaatacttctaatgacagggagcccactacctcataagctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaagccatctgtttccctctaccagttctatttggcttgcagatgccactgtacaggaatacactgtgttgaagctagcctatgcttgacctactgaacaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattg

SEQ ID NO: 164762 - DNA, 466 bp, Homo sapiens
  Payload ID: 12454
  Gene Symbol: PHF21A
  Gene Name: PHD finger protein 21A
  ENST ID: ENST00000533757
  CDS Start-End: 314-466
gtttggtccagccccgtcgtgcacgcagttcccaacacttctcgtcatcctctctttggtctctttattctgctgagcggtgctgttaggatttcttttttttttttttcccctgaccacgttcgcgatgcattgttggaaactgttactacatttttactggaaatactattattcattttaattttgggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacag

SEQ ID NO: 164763 - DNA, 507 bp, Homo sapiens
  Payload ID: 12454
  Gene Symbol: PHF21A
  Gene Name: PHD finger protein 21A
  ENST ID: ENST00000531959
  CDS Start-End: 107-507
gagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagatattttttctttccaatcagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttc

SEQ ID NO: 164764 - DNA, 490 bp, Homo sapiens
  Payload ID: 12454
  Gene Symbol: PHF21A
  Gene Name: PHD finger protein 21A
  ENST ID: ENST00000527782
  CDS Start-End: 457-490
actctttccgtttggtccagccccgtcgtgcacgcagttcccaacacttctcgtcatcctctctttggtctctttattctgctgagcggtgctgttaggatttcttttttttttttttcccctgaccacgttcgcgatgtcttctggaaggagctgcctctgaaatactcttcttctgcttacatgaagatctctaaatgctatccagcaggaggtgctacagcaagataaaggaaatttttgaattttgagggtcttgctacttattacagctctgcttagcttcagctaagcaacaggattaacaccttaaagttccagaaagattttgaggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaag

SEQ ID NO: 164765 - DNA, 561 bp, Homo sapiens
  Payload ID: 12454
  Gene Symbol: PHF21A
  Gene Name: PHD finger protein 21A
  ENST ID: ENST00000529782
  CDS Start-End: 374-561
attctgctgagcggtgctgttaggatttcttttttttttttttcccctgaccacgttcgcgatgcattgttggaaactgttactacatttttactggaaatactattattcattttaattttgggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagactttagctggacatcaggcggaagacacacatacacatgcatgtatctaatccttgaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaac

SEQ ID NO: 164766 - DNA, 546 bp, Homo sapiens
  Payload ID: 12454
  Gene Symbol: PHF21A
  Gene Name: PHD finger protein 21A
  ENST ID: ENST00000532010
  CDS Start-End: 520-546
gtgcacgcagttcccaacacttctcgtcatcctctctttggtctctttattctgctgagcggtgctgttaggatttcttttttttttttttcccctgaccacgttcgcgatgcattgttggaaactgttactacatttttactggaaatactattattcattttaattttgctttgaagggtccatcctttttcctattcagtcttctggaaggagctgcctctgaaatactcttcttctgcttacatgaagatctctaaatgctatccagcaggaggtgctacagcaagataaaggaaatttttgaattttgagggtcttgctacttattacagctctgcttagcttcagctaagcaacaggattaacaccttaaagttccagaaagattttgaggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggct

SEQ ID NO: 164767 - DNA, 1293 bp, Homo sapiens
  Payload ID: 12454
  Gene Symbol: PHF21A
  Gene Name: PHD finger protein 21A
  ENST ID: ENST00000530587
  CDS Start-End: 1-351
ttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagttcacctgagcgagtgggcccatccgtacggccctccctcgctctttcttccacaccatgctgattgcatttcccggttttcctgaccagtgtgaggaagcgggctttctagagacaagtattggaaaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaagggga

SEQ ID NO: 164768 - DNA, 557 bp, Homo sapiens
  Payload ID: 12454
  Gene Symbol: PHF21A
  Gene Name: PHD finger protein 21A
  ENST ID: ENST00000529734
  CDS Start-End: 254-557
atctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtacc

SEQ ID NO: 164769 - DNA, 577 bp, Homo sapiens
  Payload ID: 12454
  Gene Symbol: PHF21A
  Gene Name: PHD finger protein 21A
  ENST ID: ENST00000525438
  CDS Start-End: 498-577
agccccgtcgtgcacgcagttcccaacacttctcgtcatcctctctttggtctctttattctgctgagcggtgctgttaggatttcttttttttttttttcccctgaccacgttcgcgatgcattgttggaaactgttactacatttttactggaaatactattattcattttaattttgtcttctggaaggagctgcctctgaaatactcttcttctgcttacatgaagatctctaaatgctatccagcaggaggtgctacagcaagataaaggaaatttttgaattttgagggtcttgctacttattacagctctgcttagcttcagctaagcaacaggattaacaccttaaagttccagaaagattttgaggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcagga

SEQ ID NO: 164770 - DNA, 3671 bp, Homo sapiens
  Payload ID: 12455
  Gene Symbol: PHF21B
  Gene Name: PHD finger protein 21B
  Uniprot ID: Q96EK2
  ENST ID: ENST00000313237
  CDS Start-End: 152-1747
tccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaagcctcctccacgcctcctctcttcccctcaccccgcaacccatcactgtcccctccacccctcctctcttcccctcacccctccctccccatcactgtccccttcacccctccatggcatcttccaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 164771 - DNA, 3540 bp, Homo sapiens
  Payload ID: 12455
  Gene Symbol: PHF21B
  Gene Name: PHD finger protein 21B
  Uniprot ID: Q96EK2
  ENST ID: ENST00000396103
  CDS Start-End: 183-1616
atttatgagctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 164772 - DNA, 3586 bp, Homo sapiens
  Payload ID: 12455
  Gene Symbol: PHF21B
  Gene Name: PHD finger protein 21B
  ENST ID: ENST00000403565
  CDS Start-End: 679-1662
atttatgagctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaaatcgcgggcagaacctctcatctgtgcacaagggacccagcacggggctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 164773 - DNA, 557 bp, Homo sapiens
  Payload ID: 12455
  Gene Symbol: PHF21B
  Gene Name: PHD finger protein 21B
  ENST ID: ENST00000414269
  CDS Start-End: 145-557
gaattagcatcgtgccgaggcacaactttgccgaggcccaacgagatccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgagga

SEQ ID NO: 164774 - DNA, 750 bp, Homo sapiens
  Payload ID: 12455
  Gene Symbol: PHF21B
  Gene Name: PHD finger protein 21B
  ENST ID: ENST00000420689
  CDS Start-End: 176-750
agctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggc

SEQ ID NO: 164775 - DNA, 3491 bp, Homo sapiens
  Payload ID: 12455
  Gene Symbol: PHF21B
  Gene Name: PHD finger protein 21B
  Uniprot ID: Q96EK2
  ENST ID: ENST00000629843
  CDS Start-End: 101-1570
aggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttc

SEQ ID NO: 164776 - DNA, 2037 bp, Homo sapiens
  Payload ID: 12456
  Gene Symbol: PHF23
  Gene Name: PHD finger protein 23
  Uniprot ID: Q9BUL5
  ENST ID: ENST00000320316
  CDS Start-End: 228-1439
aggagggagcaggcggccggcggcgcggggggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgtttata

SEQ ID NO: 164777 - DNA, 1662 bp, Homo sapiens
  Payload ID: 12456
  Gene Symbol: PHF23
  Gene Name: PHD finger protein 23
  Uniprot ID: Q9BUL5
  ENST ID: ENST00000454255
  CDS Start-End: 124-1323
agtggccggagagttgctcaggagggaggacgtagaagaggctgagtgaggggcccggtagttcgccgaggtggggtagtttgtggcggtggtaccggagctccgagtagttgccgccggagaatgcccggtgattgtcggagagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatatt

SEQ ID NO: 164778 - DNA, 583 bp, Homo sapiens
  Payload ID: 12456
  Gene Symbol: PHF23
  Gene Name: PHD finger protein 23
  ENST ID: ENST00000574236
  CDS Start-End: 476-583
gtgctcgagtagaaggggccggagggcggggagcggttcggcgtggtcatcctggaccctgggggctggcgggcggcgtgtgcggtctcggagggcccgaggcggtggagcgcggccggatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttaccccc

SEQ ID NO: 164779 - DNA, 649 bp, Homo sapiens
  Payload ID: 12456
  Gene Symbol: PHF23
  Gene Name: PHD finger protein 23
  ENST ID: ENST00000570899
  CDS Start-End: 92-649
ctggtctccccgccgctccccgggggaggggagcggcttggtgcgcctgcgccagcctgtggctttctgggaatcaaagttccggaggttcatgcggtcccttttccgctgttcccggacggactacaaaacccttgatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggac

SEQ ID NO: 164780 - DNA, 1944 bp, Homo sapiens
  Payload ID: 12456
  Gene Symbol: PHF23
  Gene Name: PHD finger protein 23
  ENST ID: ENST00000576955
  CDS Start-End: 535-1356
tgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttt

SEQ ID NO: 164781 - DNA, 497 bp, Homo sapiens
  Payload ID: 12456
  Gene Symbol: PHF23
  Gene Name: PHD finger protein 23
  ENST ID: ENST00000574407
  CDS Start-End: 480-497
gagttgctgagggtgaggggggcatcggcggcagcagcggtggctgctgtggagagagagagagagtggctggttggggggaaggggccagagttgaggggtccatagcctagtaactgggtgatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactct

SEQ ID NO: 164782 - DNA, 575 bp, Homo sapiens
  Payload ID: 12456
  Gene Symbol: PHF23
  Gene Name: PHD finger protein 23
  ENST ID: ENST00000574323
  CDS Start-End: 398-575
gtagttgtggagagagcgagccaggaagcgaggcgagctggatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggc

SEQ ID NO: 164783 - DNA, 1768 bp, Homo sapiens
  Payload ID: 12456
  Gene Symbol: PHF23
  Gene Name: PHD finger protein 23
  Uniprot ID: Q9BUL5
  ENST ID: ENST00000571362
  CDS Start-End: 161-1171
agagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgtttat

SEQ ID NO: 164784 - DNA, 1006 bp, Homo sapiens
  Payload ID: 12456
  Gene Symbol: PHF23
  Gene Name: PHD finger protein 23
  ENST ID: ENST00000572789
  CDS Start-End: 404-1006
ctcccgggtctgtcccggccgtgaagtagcgttggatgcgtgtgcctatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaa

SEQ ID NO: 164785 - DNA, 685 bp, Homo sapiens
  Payload ID: 12456
  Gene Symbol: PHF23
  Gene Name: PHD finger protein 23
  ENST ID: ENST00000573826
  CDS Start-End: 76-685
aggggcccggtagttcgccgaggtggggtagtttgtggcggtggtaccggagctccgagtagttgccgccggagaatgcccgatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagat

SEQ ID NO: 164786 - DNA, 850 bp, Homo sapiens
  Payload ID: 12456
  Gene Symbol: PHF23
  Gene Name: PHD finger protein 23
  ENST ID: ENST00000613632
  CDS Start-End: 1-477
atgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctga

SEQ ID NO: 164787 - DNA, 5718 bp, Homo sapiens
  Payload ID: 12457
  Gene Symbol: PHF24
  Gene Name: PHD finger protein 24
  Uniprot ID: Q9UPV7
  ENST ID: ENST00000242315
  CDS Start-End: 83-1285
gctgccgtgggctgcgcggggcccgcggtgtgtagagtccgccgccccggagccgcgtcccgcacccggacggtcccgagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttggcaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggccttttcatagccatggtgacacaaaggccctcaagattagcctcctgccatcatgggttggcctgtgatctgtcccccagccaaacccaagtttgtgagagggactctgagaacacttgagcaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctc

SEQ ID NO: 164788 - DNA, 8233 bp, Homo sapiens
  Payload ID: 12458
  Gene Symbol: PHF3
  Gene Name: PHD finger protein 3
  Uniprot ID: Q92576
  ENST ID: ENST00000262043
  CDS Start-End: 341-6460
ccgcgccgccgccgcacgccgatggctgcggggtctcgcgccgtcgcaccgtccccacgcggcaagcgaccttcgggctcagggcggcggcggctgcaacgaggattaggagggcggcgcggaagccaagaatagtgtcgtcagcagcagccatttggtcccaggaggaaaagaggctgtggcagcgacgccgacgtcctgcgcgtaccccctctccgcggcacccaccgggccccctcctcctcctcttcggcggcggcagcgtccaccatcttcctcttgctgccagtggtagcgctcgtctggcggagctggggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagctttaattaccttcagacattgattttttgttactcagccaagaacatatagaaatagctatctatgtcaggcattagatgaggggaaaaacaatttttttaaaatcttaaattgtaggctgagatgaattgtgtagttctaaagaggctagaatttagaactacctgtgaaacactgtgcagctatagcccactttataggtaagtttctgaaaacttttacaccatcgcaatttggtactctgactcactaatcattaaaattaaagaccgcagaacttgaagagaaatatgttttgaatccttttataaaatgtgcgatttagcctaattcgtaaagtaactgtacagtttcatatgccagttttacttgaaaaaaaaatatgaaaactattgttaattcaaatctaaatttatttaaaccctaaaacacatggttttgatggctgtaatttaaagtaagagctatcaaatgatgctgacaaaagaaaaaccttccaaaatacaaaagaaagagaactctattatttacttacctgtattaatgaagaaaaatataaataattccacaaaattgattgttttcctaaagagcttaaagattagagttaaaaattggttttgaaacagaattatccttgttatttttgctggagagaagggaggaaattcagaaccaaacattctatttaatttgcaatgacttgcagtacttttttccctatccttatcctgtgaaacttactatcataaggttctaaaacagagaacttgtgtttaaataaagcccgtttaactttggtccacttttcttttggaaattaacttgttagaaaacaaagttagttcccaaacaaaacaaaatctaagttataatttgcaccattacaaagaaattgctgtcagggttttacacattttaaaaacatttcaatttcaaatgtgtatatcgtcaataaatctacctttactgata

SEQ ID NO: 164789 - DNA, 6947 bp, Homo sapiens
  Payload ID: 12458
  Gene Symbol: PHF3
  Gene Name: PHD finger protein 3
  Uniprot ID: Q92576
  ENST ID: ENST00000393387
  CDS Start-End: 27-6146
gggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagcttt

SEQ ID NO: 164790 - DNA, 612 bp, Homo sapiens
  Payload ID: 12458
  Gene Symbol: PHF3
  Gene Name: PHD finger protein 3
  ENST ID: ENST00000505138
  CDS Start-End: 1-509
ttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggagaagcatgacactggccaacactgcgtccagcatttgggtggccctcaggatttcccagtcctctgaaatggccatccttctcagtgcgaacttgaagagtgaaaatacagccttgaagaaatgcaaaaacacttcgtgttaacaaacagaagaaatagaaaaaacaagaagaagagattttgcctttctatacatctttagaaagaacttctcggccgggaacggtggctcatgcctgtaatccc

SEQ ID NO: 164791 - DNA, 2969 bp, Homo sapiens
  Payload ID: 12458
  Gene Symbol: PHF3
  Gene Name: PHD finger protein 3
  ENST ID: ENST00000509330
  CDS Start-End: 368-2578
gctgaggcgcgggcgcgcaggcccgaggcacggcgggcgctgcctggaaggcccgtctcgcaggcccccggatccggccgttggggcctcttccttctcagggagccccagcatggagctttgggccttggtttcgggaaactgggactggccctggctgctaggctgctccctgctgctgctttttggagatgagagttgctcttccatttatcctccagttaccgcgcgcttttgtgcccgggactcaaactgtggactccttttgcttagtttgaaatgagaagcctagactcttgccttccgataatacatgtaatttaatgaaccacttgtcgatacggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtgtgtgtgtatgtgtgtatgagtgatgtgtacattgaaaataaattgcttttttgggggtgggattaatgtgagaattgttttaaagacattatttgatacacagagacctgtgcaaaaacaaaaagcttcatcagtcttggataaatgatagaaagatggatctactgaatttacaaatatatcatcctagaacatttaaaaaagcatagtctggccaacagctgacatacatggaaatattttgtcattgtcacaggttagacagtgtaatttagccactgcatctgcaaaaaagccaaacacttcctggtaattggaaaattgttatactgctttgggtctgtaagttatatattaattcatttggtgtgagaagaactagtaataaagtatgaaggtcataatggaaa

SEQ ID NO: 164792 - DNA, 2854 bp, Homo sapiens
  Payload ID: 12458
  Gene Symbol: PHF3
  Gene Name: PHD finger protein 3
  ENST ID: ENST00000494284
  CDS Start-End: 390-2854
ccgcgccgccgccgcacgccgatggctgcggggtctcgcgccgtcgcaccgtccccacgcggcaagcgaccttcgggctcagggcggcggcggctgcaacgaggattaggagggcggcgcggaagccaagaatagtgtcgtcagcagcagccatttggtcccaggaggaaaagaggctgtggcagcgacgccgacgtcctgcgcgtaccccctctccgcggcacccaccgggccccctcctcctcctcttcggcggcggcagcgtccaccatcttcctcttgctgccagtggtagcgctcgtctggcggagctgggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctc

SEQ ID NO: 164793 - DNA, 486 bp, Homo sapiens
  Payload ID: 12458
  Gene Symbol: PHF3
  Gene Name: PHD finger protein 3
  ENST ID: ENST00000514822
  CDS Start-End: 174-486
gtatagtcacctatgtctttcacaaggggtcagcaagtaataaatggaagtgatatttgaggctaaatcaggaaagagtataatatagctaatactctctttgactaattactttacaaggtggaagtttataaaactgacttgatttgggagtttggtagtggcaatttcacatgttagaaaatttcacattccagattttcaagattgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaac

SEQ ID NO: 164794 - DNA, 3700 bp, Homo sapiens
  Payload ID: 12458
  Gene Symbol: PHF3
  Gene Name: PHD finger protein 3
  ENST ID: ENST00000506783
  CDS Start-End: 484-3700
ggcccctctccagctcccgcgccgccgccgcacgccgatggctgcggggtctcgcgccgtcgcaccgtccccacgcggcaagcgaccttcgggctcagggcggcggcggctgcaacgaggattaggagggcggcgcggaagccaagaatagtgtcgtcagcagcagccatttggtcccaggaggaaaagaggctgtggcagcgacgccgacgtcctgcgcgtaccccctctccgcggcacccaccgggccccctcctcctcctcttcggcggcggcagcgtccaccatcttcctcttgctgccagtggtagcgctcgtctggcggagctggaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtgg

SEQ ID NO: 164795 - DNA, 7124 bp, Homo sapiens
  Payload ID: 12458
  Gene Symbol: PHF3
  Gene Name: PHD finger protein 3
  ENST ID: ENST00000509876
  CDS Start-End: 66-314
cctcttgctgccagtggtagcgctcgtctggcggagctggggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacaggatagaccactatcttgttgagctcttttaaatgaagttctacttggacacaaagatgaggactagataactccttgaggttccttctaacccctaggatgaagataataactaacatttgtatagtgctctaaagtttacagagtgagttctcatacatcatctcacttgatcctcacaacagccctgtgagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcaccta

SEQ ID NO: 164796 - DNA, 2787 bp, Homo sapiens
  Payload ID: 12458
  Gene Symbol: PHF3
  Gene Name: PHD finger protein 3
  ENST ID: ENST00000481385
  CDS Start-End: 349-2787
ccctctccagctcccgcgccgccgccgcacgccgatggctgcggggtctcgcgccgtcgcaccgtccccacgcggcaagcgaccttcgggctcagggcggcggcggctgcaacgaggattaggagggcggcgcggaagccaagaatagtgtcgtcagcagcagccatttggtcccaggaggaaaagaggctgtggcagcgacgccgacgtcctgcgcgtaccccctctccgcggcacccaccgggccccctcctcctcctcttcggcggcggcagcgtccaccatcttcctcttgctgccagtggtagcgctcgtctggcggagctggttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatg

SEQ ID NO: 164797 - DNA, 3074 bp, Homo sapiens
  Payload ID: 12458
  Gene Symbol: PHF3
  Gene Name: PHD finger protein 3
  ENST ID: ENST00000515594
  CDS Start-End: 493-3074
ctctccagctcccgcgccgccgccgcacgccgatggctgcggggtctcgcgccgtcgcaccgtccccacgcggcaagcgaccttcgggctcagggcggcggcggctgcaacgaggattaggagggcggcgcggaagccaagaatagtgtcgtcagcagcagccatttggtcccaggaggaaaagaggctgtggcagcgacgccgacgtcctgcgcgtaccccctctccgcggcacccaccgggccccctcctcctcctcttcggcggcggcagcgtccaccatcttcctcttgctgccagtggtagcgctcgtctggcggagctggttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaac

SEQ ID NO: 164798 - DNA, 1086 bp, Homo sapiens
  Payload ID: 12459
  Gene Symbol: PHF5A
  Gene Name: PHD finger protein 5A
  Uniprot ID: Q7RTV0
  ENST ID: ENST00000216252
  CDS Start-End: 73-405
ggcaggaacaatgggggttaaaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacatcagtctgctgcagctgccagaaaacatgcctactactaccagcagaaagggagcagagcccagagcatcaccaggagtgcctgctagtgtactggcagcttgccaccccctcctctcccttcacccagacacgtggtagggatggaaaaggattcttcacagagcactctggcacaccatatcggagaaaacttgatagattagttaatggtttttcttgaattcgagaagcaaagatctgttctccatattggtatgttctccctcaaccaagatcttctaaaaagaaataatattttagtcttctgcttgaggaactgactgtgaagcgacgcccagtgaaaaacatgttcttgcagcagctctggtggcagctgtccttgaggaacctttggtgtgtggtgggaagctatcagaacaagaaatgtaggcatttcccgttttttttggggggggggtgggggggcagggctctgccctcttgaaaggcatttacttgtttaacacttgtccagctacagtggggtacagtagctggctattcacaggcatcatcatagcccactagtctcatattattttccttttgagaaattggaaactctttctgttgctattatattaataaagttggtgtttattttctggta

SEQ ID NO: 164799 - DNA, 4759 bp, Homo sapiens
  Payload ID: 12460
  Gene Symbol: PHF6
  Gene Name: PHD finger protein 6
  Uniprot ID: Q8IWS0
  ENST ID: ENST00000332070
  CDS Start-End: 203-1300
aagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggtatgaaagttaattatatgggatctgttgtcaggatacaatacacactgatatatacatgttgaagtaatggtatgcagtaagattttttttaatcctattatgtttagttaagagcatgttactaaaatgctgaggattttgtaggcttgcatagtagttgttttttaactagctgattttgtaaccataaaaacaagctatctgctttatcaataagtgtagttgtaatgtcaaatcaataagatattcacactcctcaataacattatattgattgtgttcccctcaagcatcatattttacatttttttatcatcttttaaacaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttc

SEQ ID NO: 164800 - DNA, 4186 bp, Homo sapiens
  Payload ID: 12460
  Gene Symbol: PHF6
  Gene Name: PHD finger protein 6
  ENST ID: ENST00000370799
  CDS Start-End: 195-1169
tccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaagtaagaaaacaacagttgtctatttccctaaacatgttagtaaccgtccttaaatagatgacattagtttactcagtctctgttcttaaatggtgtttagttaagtatagaatactgagcacattatgtaaggaatgagtactacaattggcattttcctctgactacatatccctggattagcattcatccatccaatattagttaggcttcctatgtgccagccattgtgcttgaagctgggcatatgccagtgatcaaaactacatacactgggccgggtgcggtggctcacatctgtaatcccagcactttgggaggccgaggcgggtgaatcacctgaggtcagaagttcgagaccagcctgaccaacatggtgaaaccccgtctctactaaaatacaaaaattacccaggtgtggtggcaggcacctgtaatcccagctactcgggaggctgaggcaggagaatcgcttgaacccaggaggcagaggttgcagtgagccaagattgcgccattgcactccagcctgagcaacaagagtgaaattccatctcaaacaaacaaaaaaaaaacactacatatactctcctcatgaagcttacagtctattgggagagacctattatttaagtggccaaatatgcaattacaacatagcagcgtaagtgttctaaagaagttacaaagtgttatgagagcgtataagaaggaagagctaacctagtctgtagtggggagtatttaaaatgttctgaaggaaatagtgctcagctttaagctgagatattaaggacaaaggtgagccttggttgggggaggtattctgggcagagagaagagcatatgcaagagccccgggtgagacagaagcagaggtggaaatggggagatgtgttaggaggctagtgctggtggtccaggtgagaattattggtagcttagaataggatatggtagacagaaggcaaaagattctcttgagaagatggtgaaaaagtaaagtatgaagatttgggattgggggtcaccctcttttttatgggtcttccacttacctgtgctgccttgtgctaggtggtgttaatgtatatctgtaatggttccatttgtttaatcgactggagtataagttggtagggactcttgaagttttgatttgccatccagagttgtaaagcacttccttactctcacatgcctagaatgcaataaaccaatgacttccgggtctagtattctgtgtaaaagacaatgtacacaagcagtcaccaagtcatttgggtgcctacataaggcgctatgctgtataataaaatttgccaaattctgtttaataataaaggcacaaatgttttcaagtgagttctataaagcctttaaggaacaaataatcccaatgttatttaagaggtccagcacatagcaagagatggaaaacttattgattcattctgtaaagcttacataactgtggtaccaaacctaacaaagatacgttaaaagaaaaacaaacaaactgtagaccaatctccccttttttttttttttttactttgagacaggatctgactctgttgtccaggctggagtgcagtagtgtgatcatgactcactgcagccttgaccttctgccctcacgtgatcctcccaactcagcctcccgagtagctgggactataggcgcatgccatcatgcccagctaattttttttgttttgttttttgaggaggaggaagggttttgttttgttgcccagactggtctcaaactcctgggctcaagcgttctccctgcctcagtcttctaaagtgctaggattacaggcatgagccatgcccagccacaatctcacttttataaatatacaaaaattctaaataaaatattagtaaatcaaatccagctctgtattctaagaattgaaagactgttcaggctgggcacagtggctcacacttataatctcaacactttgggaggcttaggtgggaggattgcttgaggccaggagttccagatcagtgtgggcaacaaagcgagactctcatctctatataattttaaaaatagaaagaaaaaagactgttcaaaattaggaaatatattaatataatttattagaattagtagagtaaataatcttatcaccttccttatagatggtgaaaagacatttgataacattcaacatcaatttctgaattttaaagtaacgagtgctcttggtaagctaggaatcttaataggtgtttatgagaaaaacaacagcaaataacttatttattattaaagtgaaggagcaatggttcttaaccaggagtgagcctcagaatcactgtggggtggataaggccctcttttaaaatgttcatgtctaagccctacctgtagagatttaaatttagtaggtctgggttggtgcccaaaccatgcacttttctgactccccaggtgattcttatgttcccctctaattgagaaccattagactatactttaattcagattaggaagaagacaaggatgccaactactagcatgacttttaacattcttctagagggttaagctgatgcaagacaaaaagaaagaggcccagtgcattgactcacgtctataatcccacacttgggaggccaaagcgagaggattgcttgaggccaggaattcgagaccaacctgggcaacatagtgagaccccatctctacacaacatttaaaaattagccaggcaaagtggcacacgcctgtagccccagctatacaggaggcccagactggaggattgcctgagccctggaggtagagaccagcctgggcaacatagtgagaccctgtctcaatttaaaaaataaaagaaggccgggcgcagtggctcacgcctgtaatctcaacactttgggaggccgaggctggcagatcacgaggtcaggagtttgagaccagcttcgagatcgccccactgcactccagcctgggcgacagagcgaaactctgtctcaaaaaaaaaaaaaaaa

SEQ ID NO: 164801 - DNA, 1150 bp, Homo sapiens
  Payload ID: 12460
  Gene Symbol: PHF6
  Gene Name: PHD finger protein 6
  Uniprot ID: Q8IWS0
  ENST ID: ENST00000370800
  CDS Start-End: 142-1080
cccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatggtctgtagtttttatatttgttatgcaacattacacttgatttgctgctttaaatttagagtacatcccaaatttatccagtcatcagaaaatttaaagtagttcgtatgttaaagcaaagtatatatttgacttatttgtaatataataaaggatgctgatgttactgaaa

SEQ ID NO: 164802 - DNA, 4489 bp, Homo sapiens
  Payload ID: 12460
  Gene Symbol: PHF6
  Gene Name: PHD finger protein 6
  Uniprot ID: Q8IWS0
  ENST ID: ENST00000370803
  CDS Start-End: 262-1359
cggcgcgctcgggacgtatcaacgctctgtgggtcgtgtgcgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttca

SEQ ID NO: 164803 - DNA, 4434 bp, Homo sapiens
  Payload ID: 12460
  Gene Symbol: PHF6
  Gene Name: PHD finger protein 6
  ENST ID: ENST00000625464
  CDS Start-End: 203-1303
aagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcat

SEQ ID NO: 164804 - DNA, 1472 bp, Homo sapiens
  Payload ID: 12461
  Gene Symbol: PHF7
  Gene Name: PHD finger protein 7
  Uniprot ID: Q9BWX1
  ENST ID: ENST00000347025
  CDS Start-End: 121-1149
cctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggcttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 164805 - DNA, 2130 bp, Homo sapiens
  Payload ID: 12461
  Gene Symbol: PHF7
  Gene Name: PHD finger protein 7
  Uniprot ID: Q9BWX1
  ENST ID: ENST00000327906
  CDS Start-End: 661-1806
cgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggcttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagagatgctgcctgggaactcgagccaggggctttctcagacttatatcagcgctatcagcactgtgatgcccccatctgtctgtatgaacaaggcagagacagctttgaggatgaagggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcca

SEQ ID NO: 164806 - DNA, 1303 bp, Homo sapiens
  Payload ID: 12461
  Gene Symbol: PHF7
  Gene Name: PHD finger protein 7
  ENST ID: ENST00000461861
  CDS Start-End: 1-980
gggatcccgaaaaattaggggaatttcttcagaaagacaatatcagcgtgcattatttctgtcttatcttatctagtaagctgcctcagaggggccagtccaacagaggcttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagagatgctgcctgggaactcgagccaggggctttctcagacttatatcagcgctatcagcactgtgatgcccccatctgtctgtatgaacaaggcagagacagctttgaggatgaagggaggtggtgcctcattctgtgtgctacatgcggatcccacggaacccacagggactgctcctctcttagatctaacaactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 164807 - DNA, 494 bp, Homo sapiens
  Payload ID: 12461
  Gene Symbol: PHF7
  Gene Name: PHD finger protein 7
  ENST ID: ENST00000465863
  CDS Start-End: 1-191
cccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtga

SEQ ID NO: 164808 - DNA, 2106 bp, Homo sapiens
  Payload ID: 12461
  Gene Symbol: PHF7
  Gene Name: PHD finger protein 7
  ENST ID: ENST00000620464
  CDS Start-End: 757-1503
agcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggctccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 164809 - DNA, 1421 bp, Homo sapiens
  Payload ID: 12461
  Gene Symbol: PHF7
  Gene Name: PHD finger protein 7
  Uniprot ID: Q9BWX1
  ENST ID: ENST00000614886
  CDS Start-End: 70-1098
ctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggcttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 164810 - DNA, 1328 bp, Homo sapiens
  Payload ID: 12461
  Gene Symbol: PHF7
  Gene Name: PHD finger protein 7
  ENST ID: ENST00000615126
  CDS Start-End: 84-725
aaggaatgccagagattgagaaaatctgccaagactaggagggtaacccagaggaaaccgtcttcagggcctgtttgctggctatgcttcgagaacctggggatcccgaaaaattaggggaatttcttcagaaagacaatatcagcgtgcattatttctgtcttatcttatctagtaagctgcctcagaggggccagtccaacagaggctccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 164811 - DNA, 2921 bp, Homo sapiens
  Payload ID: 12462
  Gene Symbol: PHF8
  Gene Name: PHD finger protein 8
  Uniprot ID: Q9UPP1
  ENST ID: ENST00000322659
  CDS Start-End: 177-2813
ataatagagggagccctgtgaaacaggggtcagctaggggagggttcagtgagagatgaaagaagcttcccgaaaaggcttcagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggctatcagacagcaacccccgctcccgcccaaggtgccagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggtgaagaaaatgaagctctcattaactgactcaggataatacagccagtaaatggaggagacaactcaaactcatatcctctaacttcaaatttcatattactttctatttaaataaatgcttatgtagttcagtcattacatccta

SEQ ID NO: 164812 - DNA, 6062 bp, Homo sapiens
  Payload ID: 12462
  Gene Symbol: PHF8
  Gene Name: PHD finger protein 8
  Uniprot ID: Q9UPP1
  ENST ID: ENST00000338154
  CDS Start-End: 506-3580
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaattgc

SEQ ID NO: 164813 - DNA, 4651 bp, Homo sapiens
  Payload ID: 12462
  Gene Symbol: PHF8
  Gene Name: PHD finger protein 8
  Uniprot ID: Q9UPP1
  ENST ID: ENST00000338946
  CDS Start-End: 506-3352
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaattcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggc

SEQ ID NO: 164814 - DNA, 6024 bp, Homo sapiens
  Payload ID: 12462
  Gene Symbol: PHF8
  Gene Name: PHD finger protein 8
  Uniprot ID: Q9UPP1
  ENST ID: ENST00000357988
  CDS Start-End: 360-3542
tttcctctcatcccccctcctctcccctcccctcaggctatagtcagaaaattgtgggacaggtgcaaacaaatccttgaactgtatttgaactgaagtgaaacagtagggtcaaagaagagttcagagggagttgtggagttggcagcagctttacagaggaactacactgagggcctggggacagaacgcgggtagcacagggcacaaggttcaacgtccctgctccgggactcaagtcacttggcttctcgaagcccctgccttcatttggtgataatcacagagcttccttcacagggggaagaaccaacaacgcagagaccgtgggaaagagcccagcctatcgaaggtgctcaatgaacaggagccgcgctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaattgc

SEQ ID NO: 164815 - DNA, 3344 bp, Homo sapiens
  Payload ID: 12462
  Gene Symbol: PHF8
  Gene Name: PHD finger protein 8
  ENST ID: ENST00000396282
  CDS Start-End: 1-2861
acagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctccc

SEQ ID NO: 164816 - DNA, 580 bp, Homo sapiens
  Payload ID: 12462
  Gene Symbol: PHF8
  Gene Name: PHD finger protein 8
  ENST ID: ENST00000413386
  CDS Start-End: 1-525
aatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaattctctcggggtgaagatgattacaaagccatgtttcaacaggtggcatataccacgaggcagtaaggtatagtgttcaacatcactggtgcctgcttgaatgactcagatgacgactcac

SEQ ID NO: 164817 - DNA, 2724 bp, Homo sapiens
  Payload ID: 12462
  Gene Symbol: PHF8
  Gene Name: PHD finger protein 8
  ENST ID: ENST00000443302
  CDS Start-End: 1-1978
gagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatactt

SEQ ID NO: 164818 - DNA, 555 bp, Homo sapiens
  Payload ID: 12462
  Gene Symbol: PHF8
  Gene Name: PHD finger protein 8
  ENST ID: ENST00000437224
  CDS Start-End: 211-555
atatatgtagagaaatgaattggaaaagatcctgctgaggttccctctagagagggggaagaaccaacaacgcagagaccgtgggaaagagcccagcctatcgaaggtgctcaatgaacaggagccgcgagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattc

SEQ ID NO: 164819 - DNA, 687 bp, Homo sapiens
  Payload ID: 12462
  Gene Symbol: PHF8
  Gene Name: PHD finger protein 8
  ENST ID: ENST00000415025
  CDS Start-End: 344-687
gcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaatt

SEQ ID NO: 164820 - DNA, 534 bp, Homo sapiens
  Payload ID: 12462
  Gene Symbol: PHF8
  Gene Name: PHD finger protein 8
  ENST ID: ENST00000453905
  CDS Start-End: 91-534
aaaagatcctgctgaggttccctctagagagggggaagaaccaacaacgcagagaccgtgggaaagagcccagcctatcgaaggtgctcaatgaacaggagccgcgctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgacc

SEQ ID NO: 164821 - DNA, 565 bp, Homo sapiens
  Payload ID: 12462
  Gene Symbol: PHF8
  Gene Name: PHD finger protein 8
  ENST ID: ENST00000425862
  CDS Start-End: 188-565
gaaagaaattctaagggccgggtggactttctctggttgccccctacagccgcaccagctgtgttgcatcccggcggcgtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctg

SEQ ID NO: 164822 - DNA, 555 bp, Homo sapiens
  Payload ID: 12462
  Gene Symbol: PHF8
  Gene Name: PHD finger protein 8
  ENST ID: ENST00000433120
  CDS Start-End: 263-555
gtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacag

SEQ ID NO: 164823 - DNA, 403 bp, Homo sapiens
  Payload ID: 12462
  Gene Symbol: PHF8
  Gene Name: PHD finger protein 8
  ENST ID: ENST00000448003
  CDS Start-End: 1-403
ctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaattcaacatcactggtgcctgcttgaatgactcagatga

SEQ ID NO: 164824 - DNA, 475 bp, Homo sapiens
  Payload ID: 12462
  Gene Symbol: PHF8
  Gene Name: PHD finger protein 8
  ENST ID: ENST00000445025
  CDS Start-End: 183-475
agtgagagatgaaagaagcttcccgaaaaggcttcaggtattttcttgaaacccggaaagaagttatcactgacaacggggccgaagaagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacag

SEQ ID NO: 164825 - DNA, 2726 bp, Homo sapiens
  Payload ID: 12462
  Gene Symbol: PHF8
  Gene Name: PHD finger protein 8
  ENST ID: ENST00000615775
  CDS Start-End: 865-1776
atgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttc

SEQ ID NO: 164826 - DNA, 2165 bp, Homo sapiens
  Payload ID: 12463
  Gene Symbol: PBLD
  Gene Name: phenazine biosynthesis-like protein domain containing
  Uniprot ID: P30039
  ENST ID: ENST00000309049
  CDS Start-End: 186-1052
gcctcctttgtcctggatttgggagttgagcaccttcgtcgccattggctttcctcccccagctccagcctctctcatcttgggaatctgcgtcagaagtcactcgcagtcccgtcagcccagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctatt

SEQ ID NO: 164827 - DNA, 2449 bp, Homo sapiens
  Payload ID: 12463
  Gene Symbol: PBLD
  Gene Name: phenazine biosynthesis-like protein domain containing
  ENST ID: ENST00000336578
  CDS Start-End: 165-932
aagtgccttgaattccttggtaattatttccttttaagcgtgtaactcttattattgctaaactgctttttaagttaatggtagttgttgtccaaaggaagtctgatctgtgtttttgaaacctcaatgatcgtctgtttctaattaaggaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcaccagc

SEQ ID NO: 164828 - DNA, 2587 bp, Homo sapiens
  Payload ID: 12463
  Gene Symbol: PBLD
  Gene Name: phenazine biosynthesis-like protein domain containing
  Uniprot ID: P30039
  ENST ID: ENST00000358769
  CDS Start-End: 204-1070
gaattacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcaccagc

SEQ ID NO: 164829 - DNA, 439 bp, Homo sapiens
  Payload ID: 12463
  Gene Symbol: PBLD
  Gene Name: phenazine biosynthesis-like protein domain containing
  ENST ID: ENST00000468798
  CDS Start-End: 1-271
gctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctatt

SEQ ID NO: 164830 - DNA, 1349 bp, Homo sapiens
  Payload ID: 12463
  Gene Symbol: PBLD
  Gene Name: phenazine biosynthesis-like protein domain containing
  Uniprot ID: P30039
  ENST ID: ENST00000495025
  CDS Start-End: 329-1171
cctcccaggagactttccgtttatctagctgccctagagaccagaaagctagggagagtacgccccttccccctcccgtcagcagccaagcctggcttaaaacccttcgccaccgggcggcagaattacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatggtaggacagctctttaccaatttcttttttatttgcctaattcgaagctagtgttccttctcatatgtactatccccttgaaaatgtaatacaatgtcatgtatcacccatgtgaaaatgaaaggttttaaaattccttcacccttaaagatcctccaccccaaacagccttcacctctgcctcccccaacatacagagactgtacagacacagatacagtaactgcccaataagtgtttgttgaataaaatagctgtataactttg

SEQ ID NO: 164831 - DNA, 2466 bp, Homo sapiens
  Payload ID: 12464
  Gene Symbol: PAH
  Gene Name: phenylalanine hydroxylase
  ENST ID: ENST00000307000
  CDS Start-End: 272-1615
accctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacagttttaggtacctgctgcttattgtggacacacatagaattttatgtattatttttcgacttaggctaatgatttagcaaactctggaatgtcagccctaaccccaaccttggttttctgtcacatgcatgtagaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaa

SEQ ID NO: 164832 - DNA, 705 bp, Homo sapiens
  Payload ID: 12464
  Gene Symbol: PAH
  Gene Name: phenylalanine hydroxylase
  ENST ID: ENST00000546844
  CDS Start-End: 354-705
tgagtgcgtcctggcgagtctcagcccccaagcgggtggaacgcaccaagggtctcatccgcgaggaagggctttaacgctcagggtcaggaacctctgagagctcttggggacttgcgcgcccttggatgctcttgcgttcaacagggctaggagactaccggctggggcgaggaatgcaggcgcctagagccttggagctcctgaaacgttcctgccgcctccggaaagcaagggcagtttaccgaagtgactgagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacag

SEQ ID NO: 164833 - DNA, 675 bp, Homo sapiens
  Payload ID: 12464
  Gene Symbol: PAH
  Gene Name: phenylalanine hydroxylase
  ENST ID: ENST00000551337
  CDS Start-End: 268-675
gcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggacgcgagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctc

SEQ ID NO: 164834 - DNA, 4122 bp, Homo sapiens
  Payload ID: 12464
  Gene Symbol: PAH
  Gene Name: phenylalanine hydroxylase
  Uniprot ID: P00439
  ENST ID: ENST00000553106
  CDS Start-End: 474-1832
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaacgcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaatttcactgtttcagttatttcctggaatgaaatattcctctcactgccttagaaatacattagctagatagttttgtaacatgagaaaatggccagaggctcatatctccaaccctttgcaggggctccttgtgacactcaaagtcatgcctggacagtcaacggactttgacttttgttgattgtgtgtttgccatgaaaacatgaatatctgagaagcagtggggagaaaaaaaacaatatctttgtagctatgatttgaaattctcatactactttacattttattttggaaatagttaagtcttaaagaatttgcatagtgtttctttgagtttagttctcagaacagctgtagtatcatcaacagcaaattctgggtaccttcccagctccacccaatttgaatctctgaagataaggcccagagacctgtatttttaagtaccccatttttttaattattcatagccaaattctatcaggtacattcagtttgagaaaacctgatttgtggtggtcagtctgccactgccaatgatgtcaatgtggataagctgtttcccttctttagacctcagtgtcactctaacaatgagggagttaaactttataaaccaaggtccattgcagccttgaaatatgattcaagtgttcatatgtgtctttatatagctatgcctgatccactgatggggtgttacaatacctgcttatatatgccagctgggaggaaagaggaatttactgaatgtgtctgaagtttcattgttttgaagttggaattttatgcctgtatctatgtttatgcctttgtaaaacccactgattttaaaagtgaaaaaggacttttttctctgcttttactctaaacaccaaacaatccctgcaaagggattattctgatgtttcttcatttcacatgaaaagttaattattgactctggaacttaaatattagataatatttttgacaatattgaagagtgagttttagtccagtaaagatgttttaatgagcttgaaggtaaagtttcggttaagttatgattttcacaggaagttacatactgaatgaaagataatatttgtatttttggtaatgtgctactcagttcttagctcttttttatccagatataaaagcccagtctatagctatgggatttaataaatttccaatatgtaagtgtttttatttgtttaatttctagtaaatgagcaatattttagaaacagtatcagtctttactgacagatgatcttgctgagtacaatcaaaataaatacataaaaaattctaagcatgtggcattgatgtttaataagtttctgaaagtaggaatctgaattttaactgtaggtttctaagttatataatttagttgtgtttcaaaaaatccaccaataaaatgtcagctttataaaaacagaaa

SEQ ID NO: 164835 - DNA, 652 bp, Homo sapiens
  Payload ID: 12464
  Gene Symbol: PAH
  Gene Name: phenylalanine hydroxylase
  ENST ID: ENST00000550978
  CDS Start-End: 1-449
tggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctgtgagtccatggcccgtaggatgagattttttcagtgcctctcctccactcccctcccttcctcttaccttctctacttggagcaatgtacttgttcacttgttcaacaaacacttattgtgttcctatttacacgagggctgggaaaaattagcaagactttattgtcatcatcattatcatggtcattatttttgtaggagcaaatataaatcactgtccagaaa

SEQ ID NO: 164836 - DNA, 429 bp, Homo sapiens
  Payload ID: 12464
  Gene Symbol: PAH
  Gene Name: phenylalanine hydroxylase
  ENST ID: ENST00000635477
  CDS Start-End: 1-429
acctgacatctgccatgagctgttgggacatgtgcccttgttttcagatcgcagctttgcccagttttcccagatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattgg

SEQ ID NO: 164837 - DNA, 1663 bp, Homo sapiens
  Payload ID: 12465
  Gene Symbol: FARS2
  Gene Name: phenylalanyl-tRNA synthetase 2, mitochondrial
  Uniprot ID: O95363
  ENST ID: ENST00000274680
  CDS Start-End: 157-1512
gtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaa

SEQ ID NO: 164838 - DNA, 1692 bp, Homo sapiens
  Payload ID: 12465
  Gene Symbol: FARS2
  Gene Name: phenylalanyl-tRNA synthetase 2, mitochondrial
  Uniprot ID: O95363
  ENST ID: ENST00000324331
  CDS Start-End: 337-1692
acgcggcgggagggcggggaaataagaggactggccgcccgtgcatccagccaagctcctggcggacggatatcggaggcccaggcattcgagggacgtgcagttgcatcacggagagcctttgggaaccgtctggggtcttggcggagacatttgtgtttcgggggcagcgccccttcctacatccaggaggccgcgttgcccgggttaccgaaggccgccgcaccgacgccccgcccctgaccgccgatgcccctcccacgccggctgcggtcgccctcggcgctgcctgagagagtttgcgggatttcaaggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctga

SEQ ID NO: 164839 - DNA, 434 bp, Homo sapiens
  Payload ID: 12465
  Gene Symbol: FARS2
  Gene Name: phenylalanyl-tRNA synthetase 2, mitochondrial
  ENST ID: ENST00000445533
  CDS Start-End: 1-306
ttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcaggcggcgccacctgactgagagaaaatggaaacacgaggttgctgattgaattctacgcatatctataggcatttcagaaagatctgtctggctcttttctgtaagaccattgcttaataaaaatgatggcttctaaatgtaa

SEQ ID NO: 164840 - DNA, 562 bp, Homo sapiens
  Payload ID: 12465
  Gene Symbol: FARS2
  Gene Name: phenylalanyl-tRNA synthetase 2, mitochondrial
  ENST ID: ENST00000602691
  CDS Start-End: 421-562
gcgctgcctgagagagtttgcgggatttcaagggtgacttgatttcgcctgatcctggtcggcagggtggggtttcttggcattcctcaggccgggggatgcgacgtctgggtgtggaggtgatgagctaggggttctgtggcactccggctctgctcagggcgacctgcgtaggggcctctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggttgcattatcaaatcaaggaggaaatgcaatcagagaacaggcagaaaaactatgattataatgaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccag

SEQ ID NO: 164841 - DNA, 1814 bp, Homo sapiens
  Payload ID: 12466
  Gene Symbol: FARSA
  Gene Name: phenylalanyl-tRNA synthetase, alpha subunit
  Uniprot ID: Q9Y285
  ENST ID: ENST00000314606
  CDS Start-End: 20-1546
gagcacactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgccccc

SEQ ID NO: 164842 - DNA, 1720 bp, Homo sapiens
  Payload ID: 12466
  Gene Symbol: FARSA
  Gene Name: phenylalanyl-tRNA synthetase, alpha subunit
  Uniprot ID: Q9Y285
  ENST ID: ENST00000423140
  CDS Start-End: 19-1452
agcacactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagttggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgccccc

SEQ ID NO: 164843 - DNA, 521 bp, Homo sapiens
  Payload ID: 12466
  Gene Symbol: FARSA
  Gene Name: phenylalanyl-tRNA synthetase, alpha subunit
  ENST ID: ENST00000587981
  CDS Start-End: 16-521
acactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtgcgttcctgcgggctggtcagggggcaggtggacgggcacatgggcccctggccctcatacccctcacactccttatcctggcaggtggacagcatggaggatgaggtgcagcggcggct

SEQ ID NO: 164844 - DNA, 1135 bp, Homo sapiens
  Payload ID: 12466
  Gene Symbol: FARSA
  Gene Name: phenylalanyl-tRNA synthetase, alpha subunit
  ENST ID: ENST00000593021
  CDS Start-End: 1-1135
tggcggaactgctgctccggcggctggaggcgtctgatggcggcctggacagcgccgagttggcggctgagctgggcatggagcaccaggcggtggtgggcgccgtgaagagccttcaggcgctgggcgaggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcg

SEQ ID NO: 164845 - DNA, 2057 bp, Homo sapiens
  Payload ID: 12466
  Gene Symbol: FARSA
  Gene Name: phenylalanyl-tRNA synthetase, alpha subunit
  ENST ID: ENST00000588025
  CDS Start-End: 142-1788
agagggttctgtaacccagagacggggaagtccaaggtcacacagcccgctcgaagtgaggctagataaaactcaaaacagggcggtgcttctgaccttgagataatcaattttacccctctggtcaaccagacgccattgatggagccagggtggaggtgggaactgagtcccatgcaccttttgcggctccgtcgccacactcaagatgacgacacattgagccctgttctacagttagacacattcaagatggcggtacacactccggttccggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgccccca

SEQ ID NO: 164846 - DNA, 1707 bp, Homo sapiens
  Payload ID: 12466
  Gene Symbol: FARSA
  Gene Name: phenylalanyl-tRNA synthetase, alpha subunit
  ENST ID: ENST00000586146
  CDS Start-End: 1-708
atggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccct

SEQ ID NO: 164847 - DNA, 514 bp, Homo sapiens
  Payload ID: 12466
  Gene Symbol: FARSA
  Gene Name: phenylalanyl-tRNA synthetase, alpha subunit
  ENST ID: ENST00000587488
  CDS Start-End: 1-478
tgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccagcccccaccttcctctttcccacctgtcccaggaccagaatcccagggacagaggactgggtagcaggttccttctgttgtcctgtgtggtgtgtctact

SEQ ID NO: 164848 - DNA, 3369 bp, Homo sapiens
  Payload ID: 12467
  Gene Symbol: FARSB
  Gene Name: phenylalanyl-tRNA synthetase, beta subunit
  Uniprot ID: Q9NSD9
  ENST ID: ENST00000281828
  CDS Start-End: 265-2034
acattacaatgcctgacaaatcctagccagttctatcaaattatatctttcttacaggcttttaagctattagtctcataaagatacatttaatcagcgaggtaatggcatgatgagtgtttttaggttaaaaagagaacaggaactgttgccagcagaatggcgatattcaagacaacacgcacaagaagaggcgggtcctacgcgcttcgctagggaagcccgggtcagctcgctgcgcaggcgcagtgagttcgacacaccatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatgttggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccagtgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatggtgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 164849 - DNA, 1253 bp, Homo sapiens
  Payload ID: 12468
  Gene Symbol: PNMT
  Gene Name: phenylethanolamine N-methyltransferase
  Uniprot ID: P11086
  ENST ID: ENST00000269582
  CDS Start-End: 319-1167
ctgagggtggggggcgcccagaggcgggactcggggcggggcaggcgaggcggagggcgagggctgcgggagcaagtacggagccgggggtgtgggggacgattgccgctgcagccgccgccccactcacctccggtgtgtctgcagcccggacactaagggagatggatgaatgggtggggaggatgcggcgcacatggccccgggcggctcggcggtcagctgccgcccccacagcggaccggtcggggcgggggtcgggcggtagaaaaaagggccgcgaggcgagcggggcactgggcggaccgcggcggcagcatgagcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttcgccaccggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccctgcc

SEQ ID NO: 164850 - DNA, 821 bp, Homo sapiens
  Payload ID: 12468
  Gene Symbol: PNMT
  Gene Name: phenylethanolamine N-methyltransferase
  ENST ID: ENST00000394246
  CDS Start-End: 183-737
gctgcgagggggaaactggggaaagggcctaattccccagtctccacctcgaatcaggaaagagaaggggcgggctgctgggcaaaagaggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccctg

SEQ ID NO: 164851 - DNA, 677 bp, Homo sapiens
  Payload ID: 12468
  Gene Symbol: PNMT
  Gene Name: phenylethanolamine N-methyltransferase
  ENST ID: ENST00000581428
  CDS Start-End: 14-427
ccgcggcggcagcatgagcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttcgccaccggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaaggggtaaggactggggggtgagggttggggaggaggcttcccatagagtggctggttggggcaacagaggcctgagcgtagaacagccttgagccctgccttgtgcctcctgcacagggaatgctggcaggataaggagcgccagctgcgagccagggtgaaacgggtcctgcccatcgacgtgcaccagccccagcccctgggtgctgggagcccagctcccctgcctgctgacgccctggtctctgccttctgct

SEQ ID NO: 164852 - DNA, 1262 bp, Homo sapiens
  Payload ID: 12469
  Gene Symbol: PMAIP1
  Gene Name: phorbol-12-myristate-13-acetate-induced protein 1
  Uniprot ID: Q13794
  ENST ID: ENST00000269518
  CDS Start-End: 163-573
cgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaa

SEQ ID NO: 164853 - DNA, 1948 bp, Homo sapiens
  Payload ID: 12469
  Gene Symbol: PMAIP1
  Gene Name: phorbol-12-myristate-13-acetate-induced protein 1
  Uniprot ID: Q13794
  ENST ID: ENST00000316660
  CDS Start-End: 231-395
agggaagttctcactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttc

SEQ ID NO: 164854 - DNA, 1242 bp, Homo sapiens
  Payload ID: 12470
  Gene Symbol: PDC
  Gene Name: phosducin
  Uniprot ID: P20941
  ENST ID: ENST00000391997
  CDS Start-End: 89-829
acgagttcagtagacagggattctcacccactcaacaaggacaccaggcacagagatccaaactattatatcaaatccagtccctaaaatggaagaagccaaaagccaaagtttggaggaagactttgaaggacaggccacacatacaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgagaaaataaattttctatttgaagtc

SEQ ID NO: 164855 - DNA, 1174 bp, Homo sapiens
  Payload ID: 12470
  Gene Symbol: PDC
  Gene Name: phosducin
  Uniprot ID: P20941
  ENST ID: ENST00000497198
  CDS Start-End: 193-777
aaatgtgtggagatttattttataatagcaatgtgaggaataccttcctaattatgacaaaaacaaaaacaacaacaaaaagaccattgaagaaaaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgagaaaataaa

SEQ ID NO: 164856 - DNA, 2813 bp, Homo sapiens
  Payload ID: 12471
  Gene Symbol: PDCL
  Gene Name: phosducin-like
  Uniprot ID: Q13371
  ENST ID: ENST00000259467
  CDS Start-End: 167-1072
cgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataata

SEQ ID NO: 164857 - DNA, 595 bp, Homo sapiens
  Payload ID: 12471
  Gene Symbol: PDCL
  Gene Name: phosducin-like
  ENST ID: ENST00000394285
  CDS Start-End: 1-328
actgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaaggagagatgaggctttgccatgttggccaggctggtcttgaactcctgacctcaagtgatccgctcgtctcagcctcccaaagtgctaggattacaggcgtgagccaccgcgcccggcccatattaactgttatcacgagtgttcagttttcatatttatgctcacttgctggtccgcctgcagatgactctgaaggagtttgccataatgaatgaggaccaagatgatgaagagtttctgcagcagtaccggaagcagcgaatggaagagatgcgg

SEQ ID NO: 164858 - DNA, 404 bp, Homo sapiens
  Payload ID: 12471
  Gene Symbol: PDCL
  Gene Name: phosducin-like
  ENST ID: ENST00000436632
  CDS Start-End: 1-274
atgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagaaatcttgggcaattctgtaagaagagaattgaagtaactgagaggaattttagggcacaggtttgctgaagactgtgctgaaaccacctttacagggaaatgatcttttaatttatttccacatctttctctattaaaaaaaaatcaatg

SEQ ID NO: 164859 - DNA, 861 bp, Homo sapiens
  Payload ID: 12472
  Gene Symbol: PDCL2
  Gene Name: phosducin-like 2
  Uniprot ID: Q8N4E4
  ENST ID: ENST00000295645
  CDS Start-End: 104-829
gaagcgggcgctcttccagcctggagaaggctgcgggtctccatccgtggcgcctcgccagctgcaggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaaccatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagcatcccaatgtgtttgttggttaaccagcatcttagtcttctagcaagaaagtttccagaaactaaatttgttaaagccatcgtgaatagctgtattcaacactaccatgacaattgtttaccaacaatttttgtgtataaaaatggtcagatagaagccaaattcattggaattatagaatgtggagggataaatctcaagctggaagaacttgaatggaagctagcagaagttggagcaatacagactgatttggaagaaaaccccagaaaagacatggtagatatgatggtatcttcaattagaaacacttctattcatgatgacagtgatagctccaacagtgataatgataccaaatagagagaaatattcaataaatagcttttagtata

SEQ ID NO: 164860 - DNA, 857 bp, Homo sapiens
  Payload ID: 12472
  Gene Symbol: PDCL2
  Gene Name: phosducin-like 2
  ENST ID: ENST00000615028
  CDS Start-End: 104-856
gaagcgggcgctcttccagcctggagaaggctgcgggtctccatccgtggcgcctcgccagctgcaggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaaccatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagcatcccaatgtgtttgttggttaaccagcatcttagtcttctagcaagaaagtttccagaaactaaatttgttaaagccatcgtgaatagctgtattcaacactaccatgacaattgtttaccaacaatttttgtgtataaaaatggtcagatagaagccaaattcattggaattatagaatgtggagggataaatctcaagctggaagaacttgaatggaagctagcagaagttggagcaatacagactgatttggaagaaaaccccagaaaagacatggtagatatgatggtatcttcaattagaaacacttctattcatgatgacagtgatagctccaacagtgataatgatccaaatagagagaaatattcaataaatagcttttagt

SEQ ID NO: 164861 - DNA, 1337 bp, Homo sapiens
  Payload ID: 12473
  Gene Symbol: PDCL3
  Gene Name: phosducin-like 3
  Uniprot ID: Q9H2J4
  ENST ID: ENST00000264254
  CDS Start-End: 379-1098
gtctttacaggtttgggccggcagctggaaaaggcacacggccccgggctcctcctccacccagccccacccctcctccgctgaagaccagccctaataaggcagccaccagaattagaaccaggtcaagtgcactccgagcaggacagtaggcagatcctatctggcgcatgcgaacgcttctgtgccagttccttgaagagcaggcgcagactcaaggctgttgcttccgcccttactccccgccgctcgtccctgggcggggcgaaggctgggctgggggaagaggcgtggcggcgctgtgcgcgtgcacaaaagagagctgaggggcgggggcgctgcggcacagctggtttgagcaactgaactggaaacaagatgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaattcggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatgagttggaatggaaactgtctgaatctggagcaattatgacagacctggaggaaaaccctaagaagccgattgaagacgtgttgctgtcctcagtgcggcgctctgtcctcatgaagagggacagcgattccgagggtgactgaggctacagcttctatcacatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactctttttttttttaaattatagtatttcctctaaaaaaaattaaaaccagccatttgtatggcaaa

SEQ ID NO: 164862 - DNA, 662 bp, Homo sapiens
  Payload ID: 12473
  Gene Symbol: PDCL3
  Gene Name: phosducin-like 3
  ENST ID: ENST00000450127
  CDS Start-End: 1-452
tggaagagctggaggatcatgaagacgagtttaatgaggaggatgaacgtgctattgaaatgtacagacggcggagactggctgagtggaaagcaactaaactgaagaataaattcggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatggtaagggctctgggagacaggcggggcagtgagagatgggaggcgcatttctgttggagagagtgtctatttcctggactcctgttacgatggtgggtcaagttcacttctgcctgtgtatgaggacggaagcacgtttaatctctcatcttagttgcgtaatcaggaacagttacaactgggctctactgattcttagttcaaggaaggcgtgatagacttaaatataaacattttttata

SEQ ID NO: 164863 - DNA, 657 bp, Homo sapiens
  Payload ID: 12473
  Gene Symbol: PDCL3
  Gene Name: phosducin-like 3
  ENST ID: ENST00000416255
  CDS Start-End: 397-657
ggcctgggcgtccccgcctcggtgtgccgggtcccccaaacctcgtcctccgggactatgtcttctcgcggtctctacccacccgggcctgtgaaggtcttgccggatcccgcctaacaaaagttacctcctctcctgaactcccctaaggcacacctgggcagaggtgttaggaagcggagggtccggcctggggtcttccgcacgtaaagcagcgccacagccggtgttcctggctccactgagagccaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaattcggagaagttttggagatctcagggaaggattatgttcaagaagttaccaaagctggcgagggcttgtgggtcatcttgcacctttacaaacaaggaattcccctctgtgccctgataaatcagcacctcagtggactt

SEQ ID NO: 164864 - DNA, 5332 bp, Homo sapiens; identical to SEQ ID NO: 164666
  Payload ID: 12474
  Gene Symbol: PHACTR1
  Gene Name: phosphatase and actin regulator 1
  Uniprot ID: Q9C0D0
  ENST ID: ENST00000332995
  CDS Start-End: 184-1926

SEQ ID NO: 164865 - DNA, 707 bp, Homo sapiens; identical to SEQ ID NO: 164664
  Payload ID: 12474
  Gene Symbol: PHACTR1
  Gene Name: phosphatase and actin regulator 1
  ENST ID: ENST00000379329
  CDS Start-End: 21-443

SEQ ID NO: 164866 - DNA, 943 bp, Homo sapiens; identical to SEQ ID NO: 164661
  Payload ID: 12474
  Gene Symbol: PHACTR1
  Gene Name: phosphatase and actin regulator 1
  ENST ID: ENST00000379335
  CDS Start-End: 106-540

SEQ ID NO: 164867 - DNA, 795 bp, Homo sapiens; identical to SEQ ID NO: 164667
  Payload ID: 12474
  Gene Symbol: PHACTR1
  Gene Name: phosphatase and actin regulator 1
  ENST ID: ENST00000379348
  CDS Start-End: 178-687

SEQ ID NO: 164868 - DNA, 4784 bp, Homo sapiens; identical to SEQ ID NO: 164663
  Payload ID: 12474
  Gene Symbol: PHACTR1
  Gene Name: phosphatase and actin regulator 1
  Uniprot ID: Q9C0D0
  ENST ID: ENST00000379350
  CDS Start-End: 130-1584

SEQ ID NO: 164869 - DNA, 792 bp, Homo sapiens; identical to SEQ ID NO: 164662
  Payload ID: 12474
  Gene Symbol: PHACTR1
  Gene Name: phosphatase and actin regulator 1
  ENST ID: ENST00000406205
  CDS Start-End: 1-792

SEQ ID NO: 164870 - DNA, 2257 bp, Homo sapiens; identical to SEQ ID NO: 164665
  Payload ID: 12474
  Gene Symbol: PHACTR1
  Gene Name: phosphatase and actin regulator 1
  ENST ID: ENST00000415087
  CDS Start-End: 29-1495

SEQ ID NO: 164871 - DNA, 760 bp, Homo sapiens; identical to SEQ ID NO: 164660
  Payload ID: 12474
  Gene Symbol: PHACTR1
  Gene Name: phosphatase and actin regulator 1
  ENST ID: ENST00000434977
  CDS Start-End: 1-693

SEQ ID NO: 164872 - DNA, 1851 bp, Homo sapiens
  Payload ID: 12475
  Gene Symbol: PHACTR2
  Gene Name: phosphatase and actin regulator 2
  Uniprot ID: O75167
  ENST ID: ENST00000305766
  CDS Start-End: 126-1790
atgaagtatgctcagtgtgccagcaagggctgataatcagcagaaggacagggtgcttcgttagtcagaagagccagggcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctg

SEQ ID NO: 164873 - DNA, 4367 bp, Homo sapiens
  Payload ID: 12475
  Gene Symbol: PHACTR2
  Gene Name: phosphatase and actin regulator 2
  Uniprot ID: O75167
  ENST ID: ENST00000367582
  CDS Start-End: 182-1879
gccgcgccggctgcggccggccgggctgggagacccgcgcggggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaa

SEQ ID NO: 164874 - DNA, 2490 bp, Homo sapiens
  Payload ID: 12475
  Gene Symbol: PHACTR2
  Gene Name: phosphatase and actin regulator 2
  ENST ID: ENST00000367584
  CDS Start-End: 147-2015
accggctcctcggcgcccggcgtccacctccccgcccttctcgctgcctccgggtcgcggcgcgcggggcagagccgggcagcagcgggcagcgcagccctcggcgccggccccacccggtgctccggccccgccgccgggagccgatggccgaggcgggctggcgccccgcggcgtccccggtcgatccggccgggcaggcggcggcggtcccagtccccgagcccgaggcgcccgccccgccggcggcgcctgccctgcgctggcttcccggggacccgagcccccgcggccgctcacagagcgacctctcgtcgtcctcgagcaggggccgcccgctccgggtccacatctccggctcagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtag

SEQ ID NO: 164875 - DNA, 745 bp, Homo sapiens
  Payload ID: 12475
  Gene Symbol: PHACTR2
  Gene Name: phosphatase and actin regulator 2
  ENST ID: ENST00000397980
  CDS Start-End: 97-558
ggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagactgttgaatttcaaatccatctgtggtttgtccctggcagccttctcacatccaagaatcgcatcctgcattacgtaacagtgccatctctggtgcctggtccgtgcagggtattcgtcactggactggccagacatcaaaggaagtgtttcccttatcaacataataaaaagttcctgacagttttatatgaa

SEQ ID NO: 164876 - DNA, 9531 bp, Homo sapiens
  Payload ID: 12475
  Gene Symbol: PHACTR2
  Gene Name: phosphatase and actin regulator 2
  Uniprot ID: O75167
  ENST ID: ENST00000427704
  CDS Start-End: 131-2035
agtgcatgaagtatgctcagtgtgccagcaagggctgataatcagcagaaggacagggtgcttcgttagtcagaagagccagggcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaagctgtattttgcagaatatggttctattttagtagagcagagatgagacatatccccaccggccacccagccagaggtctcctacctgggggccctaaagggatgcagaggtctggcccaccctccgtgcataggcacctctgtccaccaccagcgtttcagcaatccaaccagtaagcatatgctgtataggaaaaataaaagtgtgtgggaattggatttcttttgttgtaacacaattccaggtttttggctatttaaagtttgacattaggctgacatcgaggaagtaagtgggttttcctgagttcccaagatatgattaaggaagaaaacaaacccatctccaggaagatcccaggcaggaaagaactagacagatgtagaaaccaaagtgaccattttagtttttttattggagaataaaacattaatattagggtattaagaagatgctcagcaagcttgatcagaatcttcatggtcattaccaatcagtctgacaaaatagttctctggtagtcagcattcatttaaggcagcttgcctgataatttcctgtgttatgtgaagtgtcttgcactttcacatgttagctataattccttaaattacttaactgaaatctgtaatagagaaccattttggcatttgaacagctattttacatggagaaaaagcaaacacatctgtttgctttacccagaaaaactgactttctggtttcatcttcatattgtttagtagcataatgagagtagtcctttatctttctctaatgttagtaaatatattctgttagtaggaagttctgaaattgaagggaaaatatatttaaggaaataaaggaattcaatacacccttcaaaagtcaccaaatactgaaaataagagatgagtccttaaaacctgagtcaaaaaaggtccagttttacagcctgcaattaattcagggctgcgttggcattaaaaaagaaaatatatatatatatatatatatatatatatatatatatatatatgtatattatatatacagtagcttacacttaaaagaggaaaaatttgcattaacattgcatattctgatatgtaccatattaacacataacaggcattttatttatgcttcatagaatcagacagacacaactttcaaaaatcttactgtattcacaatagaaaagggtagtcttgtctaccacagaggagtatgtccacacttaataatgaaaactttcttcctttcctgcccaaaaatttcttcagtctgttattatttttaagtgccccttgctgcaaatttcaaacagagcaagaaatcttcctcagagtaggtggtatgaaattaaactagtacaatatatatgaattcatgtcatttacccctgagtatggtagaattgttaaagcattcttaaattccaattatatgaagcctatcattactaggaaaagtatattctttgggataagaattaatttcttcacactattagagcatgttgtgagtagtaaggaactacttagatgcaatttatttacagaattgtcccttgacctcttgaaatggctagatctttcactactgtgtaggtagtctctacttactggtaggatagattacattgctttactggacaaagcagaatgaacttatataactaaaatatgtcctatattggctgggtgcggtggcttacacctgtaataccagcactttgggaggccaaggtgggtggatcagttgaggtcaggagttcgagaccagcctggccaacatggtgaaaccctgtctctactgaaaatacaaaaaaaaaaaagtatctgggcatggtggcttgtgcctgtaatcccagctacttgggaggctgaggcagggaaatcgcttaaacccgggaggtggaggttgcagtgggcccagatcgtgccactccactccagcctgggagacagagcaagactccatctcaaaataataataatagtaataatgaataaaataaaataaaatatgtcctccagggaaaagcaatgacagagtaatcaccaaattaataggaacatctttctagagaaagtacatgcccagttagttcaaacccaggtttcaaagaagtagcactgggctctactgtaaaggcaggcagtgaccaagaggtggtggggagagaggtagagtaccctcaaatcattcccattttcacttccaatttcccttttgtaatcattaagcttaagctatgtatggaaatgcaaagcaccattagcatttctagaaagcagctggaaccttacccaccaatgcttttttgaagacagtatcatcccaaatttaaaaatcctattgtatatgttgtaaaatttctggcaaagaaatggaggatcctgtggcagctattcccacctaaagccaaccctataaggatgggtcattttttagccatgctaggatttactgcacacacaaaaaatgtcatttagcttgtcacattgctagcacagctgcacatatgagcaaagcactgttggtctgtgtttctcagtgggggtactcttggcatttggagctggataggtctttgctgtacagaatcatcccatgcattgccagatgtttaatatcccaggcccctgctgactaaatgtcagtagcattctcagtcattgtaaacaccaagaataaaaagcattcccccaggttcaaatgccctccctgggaggttggtatcacctcccctgaatgccactgtctactgcattttgaggacacagggagaaaaagtgcctatcctcaaacattgtctctgctgccttgcatttctttgggccctgaatggtttttctcccttcatttttcgagcctttctctcagtgcagctgttcttcagggaggaggttactgggcagccttggccattcagtgggcatggggacttggcctagtccctatatatatatacttaaagtccctatatatacttaaaggagagatcatacatgaagaaagcttttttttttttttttttttttgccttacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacattacttggatgaactgtggctagcaaaatggaattaacttagccactataattttttaaaacattaaagtttctaaattgtttttggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttcttttttttttttttttttctgtgtaacagggatttttaaataacggactatatgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatccccagttttagtttgttccagtttctcttatatttggatagtgctcagcctttttaaatgaaaaaagaaaaaagagtaagacaacttccctaattgcctgttatttcagcttcacctaagtttttaacacctctttgtatgtaaggtcttgagacatgtaaggcctggtactttttatttaaaatgtctgtctaaagaattactgctcttaaaagaaacttccagtattttttttaacttgctatctttttatgtctgaggtatttgatattgatgtttttattgccattattatatgtaaacataaaagatagtccatttagagtttataatatagaaaataaacagacttcctcatta

SEQ ID NO: 164877 - DNA, 675 bp, Homo sapiens
  Payload ID: 12475
  Gene Symbol: PHACTR2
  Gene Name: phosphatase and actin regulator 2
  ENST ID: ENST00000451827
  CDS Start-End: 141-675
gggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtgg

SEQ ID NO: 164878 - DNA, 2569 bp, Homo sapiens
  Payload ID: 12475
  Gene Symbol: PHACTR2
  Gene Name: phosphatase and actin regulator 2
  Uniprot ID: O75167
  ENST ID: ENST00000440869
  CDS Start-End: 200-2137
atccgctgggcaggatccgccgcgccggctgcggccggccgggctgggagacccgcgcggggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaat

SEQ ID NO: 164879 - DNA, 616 bp, Homo sapiens
  Payload ID: 12475
  Gene Symbol: PHACTR2
  Gene Name: phosphatase and actin regulator 2
  ENST ID: ENST00000542769
  CDS Start-End: 117-616
gggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaa

SEQ ID NO: 164880 - DNA, 2247 bp, Homo sapiens
  Payload ID: 12476
  Gene Symbol: PHACTR3
  Gene Name: phosphatase and actin regulator 3
  Uniprot ID: Q96KR7
  ENST ID: ENST00000355648
  CDS Start-End: 110-1666
acctttcagggagatttgagagaaagactccagaagcccgcggggagagcaggggttctggggaagataaagcccttcatccaggatccctctgtgaccataagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 164881 - DNA, 2252 bp, Homo sapiens
  Payload ID: 12476
  Gene Symbol: PHACTR3
  Gene Name: phosphatase and actin regulator 3
  Uniprot ID: Q96KR7
  ENST ID: ENST00000359926
  CDS Start-End: 1-1671
atgcgtggccgtggcggggggcgcgcccgctgtcctgcgcccctgcgctcgctgctgggcgccttcggggcccgggacgctgccgccgccgcccgagatcctgcgcaagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 164882 - DNA, 2162 bp, Homo sapiens
  Payload ID: 12476
  Gene Symbol: PHACTR3
  Gene Name: phosphatase and actin regulator 3
  Uniprot ID: Q96KR7
  ENST ID: ENST00000361300
  CDS Start-End: 235-1581
cattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctggatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 164883 - DNA, 2728 bp, Homo sapiens
  Payload ID: 12476
  Gene Symbol: PHACTR3
  Gene Name: phosphatase and actin regulator 3
  Uniprot ID: Q96KR7
  ENST ID: ENST00000371015
  CDS Start-End: 468-2147
gcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 164884 - DNA, 2372 bp, Homo sapiens
  Payload ID: 12476
  Gene Symbol: PHACTR3
  Gene Name: phosphatase and actin regulator 3
  Uniprot ID: Q96KR7
  ENST ID: ENST00000395636
  CDS Start-End: 235-1791
cattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctggatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 164885 - DNA, 539 bp, Homo sapiens
  Payload ID: 12476
  Gene Symbol: PHACTR3
  Gene Name: phosphatase and actin regulator 3
  ENST ID: ENST00000434923
  CDS Start-End: 415-539
cacactgccagcgctcacactgcactcccaggccctgctgtaggtgctaatctgatgggggcagccttagggagggctctgtccccagcaggaggacccttggtgtctctgtggtccttgaatcctggtgtctgttgaaatgcctcctcctctgggcaccttccaggaccaggccaggtgacaccaccattccacccccgtctctacccctttcctggactttcttccttccctgccctggctggggaagcagcggctgcctgcctgtgttcaccccacaccaccgctggggttgtgagaatcgctccttagcaccctggaggacacctctccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccagatgagat

SEQ ID NO: 164886 - DNA, 2349 bp, Homo sapiens
  Payload ID: 12476
  Gene Symbol: PHACTR3
  Gene Name: phosphatase and actin regulator 3
  Uniprot ID: Q96KR7
  ENST ID: ENST00000541461
  CDS Start-End: 214-1770
aaaaacacaaagaaacaaaaagtacgggagaggatcagttcattctcctgactcctggttggtctcaagacctcccctgttgcctgtgctctggaagattccccatagtacctactaggtgggccagagaaggatggatttgtgggaccctggaaggctgggaagaggactgagaagccacagccctgcgctgggaagagccacggagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaatt

SEQ ID NO: 164887 - DNA, 3107 bp, Homo sapiens
  Payload ID: 12477
  Gene Symbol: PHACTR4
  Gene Name: phosphatase and actin regulator 4
  Uniprot ID: Q8IZ21
  ENST ID: ENST00000373836
  CDS Start-End: 215-2353
gtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatccca

SEQ ID NO: 164888 - DNA, 6190 bp, Homo sapiens
  Payload ID: 12477
  Gene Symbol: PHACTR4
  Gene Name: phosphatase and actin regulator 4
  Uniprot ID: Q8IZ21
  ENST ID: ENST00000373839
  CDS Start-End: 262-2370
cccgccattttgttcagcttgccgggcaaccggcccctgctggggactacaagtcccgtaagcctccgcggcggcacgtcctaccctacactgtccagccggctccctttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttctcatcaatattaattattaaatattttagaatttttaaataccaactata

SEQ ID NO: 164889 - DNA, 918 bp, Homo sapiens
  Payload ID: 12477
  Gene Symbol: PHACTR4
  Gene Name: phosphatase and actin regulator 4
  ENST ID: ENST00000632202
  CDS Start-End: 256-918
attttgttcagcttgccgggcaaccggcccctgctggggactacaagtcccgtaagcctccgcggcggcacgtcctaccctacactgtccagccggctccctttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgacttctccagagaaccttggaacaaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgct

SEQ ID NO: 164890 - DNA, 553 bp, Homo sapiens
  Payload ID: 12477
  Gene Symbol: PHACTR4
  Gene Name: phosphatase and actin regulator 4
  ENST ID: ENST00000633167
  CDS Start-End: 235-553
ttcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttgacttctccagagaaccttggaacaaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctg

SEQ ID NO: 164891 - DNA, 3078 bp, Homo sapiens
  Payload ID: 12477
  Gene Symbol: PHACTR4
  Gene Name: phosphatase and actin regulator 4
  Uniprot ID: Q8IZ21
  ENST ID: ENST00000493669
  CDS Start-End: 121-312
tgctgcctggcggccaacgggccaggtaggatttccgggagaggctgctgtggaggctgaggaggcggcggcggagatctggaaacagtatctcacctccctaaactggttaatagtggcatggaagatccatttgacttctccagagaaccttggaacagtagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacaatatagagtgaaatttggccttaaaagtctcctcactgagaaggtttgggcttccttggggctatttgtgagcatgttcagtctgaccaatccatcccctgttctctcagcactacttggctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacggcaggggcctggtgcagtggtacacacctgtaatcctagcactttgggaggccgaggtgggaggatcactttgagaccagcctgggaaacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctga

SEQ ID NO: 164892 - DNA, 3375 bp, Homo sapiens
  Payload ID: 12477
  Gene Symbol: PHACTR4
  Gene Name: phosphatase and actin regulator 4
  ENST ID: ENST00000632421
  CDS Start-End: 155-280
tttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgagatggggttttaccatgttacccaggctggtcttgaactcctggactcaagcaacccccgcttggcctcccaaagtgctgggattagaggcgtgagccactgcacctgacctaagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaa

SEQ ID NO: 164893 - DNA, 9027 bp, Homo sapiens
  Payload ID: 12478
  Gene Symbol: PTEN
  Gene Name: phosphatase and tensin homolog
  Uniprot ID: P60484
  ENST ID: ENST00000371953
  CDS Start-End: 1358-2569
ggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaaaatgaaatttatactgtacctgatctcaaagctttttagcttagtatatctgtcatgaatttgtaggatgttccattgcatcagaaaacggacagtgatttgattactttctaatgccacagatgcagattacatgtagttattgagaatcctttcgaattcagtggcttaatcatgaatgtctaaatattgttgacattaggatgatacatgtaaattaaagttacatttgtttagcatagacaagcttaacattgtagatgtttctcttcaaaaatcatcttaaacatttgcatttggaattgtgttaaatagaatgtgtgaaacactgtattagtaaacttcatcacctttctacttccttatagtttgaacttttcagtttttgtagttcccaaacagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttcctctgttgcatgaggattctcatctgtgcttataatggttagagattttatttgtgtggaatgaagtgaggcttgtagtcatggttctagtgtttcagtttgccaagtctgtttactgcagtgaaattcatcaaatgtttcagtgtggttttctgtagcctatcatttactggctatttttttatgtacacctttaggattttctgcctactctatccagttgtccaaatgatatcctacattttacaaatgccctttcagtttctattttctttttccattaaattgccctcatgtcctaatgtgcagtttgtaagtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgacta

SEQ ID NO: 164894 - DNA, 1605 bp, Homo sapiens
  Payload ID: 12478
  Gene Symbol: PTEN
  Gene Name: phosphatase and tensin homolog
  ENST ID: ENST00000610634
  CDS Start-End: 1135-1605
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggcagatcctacaggaggtattccagataaaggcattattgtcataggagatggcagctccatggatgttattgccccttaa

SEQ ID NO: 164895 - DNA, 644 bp, Homo sapiens
  Payload ID: 12478
  Gene Symbol: PTEN
  Gene Name: phosphatase and tensin homolog
  ENST ID: ENST00000472832
  CDS Start-End: 1-462
gcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttgttgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaaaaaa

SEQ ID NO: 164896 - DNA, 4555 bp, Homo sapiens
  Payload ID: 12479
  Gene Symbol: PALD1
  Gene Name: phosphatase domain containing, paladin 1
  Uniprot ID: Q9ULE6
  ENST ID: ENST00000263563
  CDS Start-End: 269-2839
gcaggtcccgtcgccggtgagcacgggctccctctcgcgtggcctcgccgggtccgcctggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggtctggggtcctgaggctgctggcagactatgggtacaacggccagcacagcccagcagacggtctcggcaggcaccccatttgagggcctacagggcagtggcacgatggacagtcggcactccgtcagcatccactccttccagagcactagcttgcataacagcaaggccaagtccatcatccccaacaaggtggcccctgttgtgatcacgtacaactgcaaggaggagttccagatccatgatgagctgctcaaggctcattacacgttgggccggctctcggacaacacccctgagcactacctggtgcaaggccgctacttcctggtgcgggatgtcactgagaagatggatgtgctgggcaccgtgggaagctgtggggcccccaacttccggcaggtgcagggtgggctcactgtgttcggcatgggacagcccagcctctcagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaagaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttgttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgattttttttttttttgtacagagcttttaagcattaaaaacagctaaatgtg

SEQ ID NO: 164897 - DNA, 1816 bp, Homo sapiens
  Payload ID: 12480
  Gene Symbol: PHOSPHO1
  Gene Name: phosphatase, orphan 1
  Uniprot ID: Q8TCT1
  ENST ID: ENST00000310544
  CDS Start-End: 129-932
cttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaagggggaagaaa

SEQ ID NO: 164898 - DNA, 2173 bp, Homo sapiens
  Payload ID: 12480
  Gene Symbol: PHOSPHO1
  Gene Name: phosphatase, orphan 1
  Uniprot ID: Q8TCT1
  ENST ID: ENST00000413580
  CDS Start-End: 419-1297
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaaggg

SEQ ID NO: 164899 - DNA, 837 bp, Homo sapiens
  Payload ID: 12480
  Gene Symbol: PHOSPHO1
  Gene Name: phosphatase, orphan 1
  ENST ID: ENST00000503902
  CDS Start-End: 339-837
ggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgtgtcatggcctggtgcgggaggctcttacctccccaagccccactgcttctcctgctgcccgcttgcttcggactctggcagaaaccccacctgctgacacgttcctcctggggaattggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcg

SEQ ID NO: 164900 - DNA, 868 bp, Homo sapiens
  Payload ID: 12480
  Gene Symbol: PHOSPHO1
  Gene Name: phosphatase, orphan 1
  ENST ID: ENST00000511066
  CDS Start-End: 258-868
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacgg

SEQ ID NO: 164901 - DNA, 733 bp, Homo sapiens
  Payload ID: 12480
  Gene Symbol: PHOSPHO1
  Gene Name: phosphatase, orphan 1
  ENST ID: ENST00000512250
  CDS Start-End: 400-733
cggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgc

SEQ ID NO: 164902 - DNA, 1587 bp, Homo sapiens
  Payload ID: 12480
  Gene Symbol: PHOSPHO1
  Gene Name: phosphatase, orphan 1
  Uniprot ID: Q8TCT1
  ENST ID: ENST00000514112
  CDS Start-End: 123-1001
caggaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaa

SEQ ID NO: 164903 - DNA, 391 bp, Homo sapiens
  Payload ID: 12480
  Gene Symbol: PHOSPHO1
  Gene Name: phosphatase, orphan 1
  ENST ID: ENST00000574638
  CDS Start-End: 133-391
gggaagaaacccaagatgcctgactttctgccttggagactgaaagaaacaagggcaactcaccaaacagtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgc

SEQ ID NO: 164904 - DNA, 1125 bp, Homo sapiens
  Payload ID: 12481
  Gene Symbol: PHOSPHO2
  Gene Name: phosphatase, orphan 2
  Uniprot ID: Q8TCD6
  ENST ID: ENST00000359744
  CDS Start-End: 389-1114
tgctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagcaa

SEQ ID NO: 164905 - DNA, 468 bp, Homo sapiens
  Payload ID: 12481
  Gene Symbol: PHOSPHO2
  Gene Name: phosphatase, orphan 2
  ENST ID: ENST00000438838
  CDS Start-End: 302-468
agttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctgggaaccagtcagaagcatctggattaggcatttagtgatacaaggatccagaataacaaaaactatgtaccagccacattcacacaacagggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttggg

SEQ ID NO: 164906 - DNA, 908 bp, Homo sapiens
  Payload ID: 12481
  Gene Symbol: PHOSPHO2
  Gene Name: phosphatase, orphan 2
  ENST ID: ENST00000438710
  CDS Start-End: 502-908
agttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggtcagtgagaagcccgtgggcccccgccctgcctgctactcccatccccacctgcgcgctccccatgggggacgacccccgattgggtccgatgcctaccctcggggtggagccggcaggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgt

SEQ ID NO: 164907 - DNA, 631 bp, Homo sapiens
  Payload ID: 12481
  Gene Symbol: PHOSPHO2
  Gene Name: phosphatase, orphan 2
  ENST ID: ENST00000449906
  CDS Start-End: 485-631
agagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttgggaaagtgaattctgcatttaaatttcagggaaccagtcagaagcatctggattaggcatttagtgatacaaggatccagaataacaaaaactatgtaccagccacattcacacaacagggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggc

SEQ ID NO: 164908 - DNA, 1253 bp, Homo sapiens
  Payload ID: 12481
  Gene Symbol: PHOSPHO2
  Gene Name: phosphatase, orphan 2
  Uniprot ID: Q8TCD6
  ENST ID: ENST00000616524
  CDS Start-End: 519-1244
aacaagggaggtgctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggtcagtgagaagcccgtgggcccccgccctgcctgctactcccatccccacctgcgcgctccccatgggggacgacccccgattgggtccgatgcctaccctcggggtggagccggcaggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagc

SEQ ID NO: 164909 - DNA, 1252 bp, Homo sapiens
  Payload ID: 12481
  Gene Symbol: PHOSPHO2
  Gene Name: phosphatase, orphan 2
  Uniprot ID: Q8TCD6
  ENST ID: ENST00000616481
  CDS Start-End: 518-1243
aacaagggaggtgctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttgggaaagtgaattctgcatttaaatttcagggaaccagtcagaagcatctggattaggcatttagtgatacaaggatccagaataacaaaaactatgtaccagccacattcacacaacagggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagc

SEQ ID NO: 164910 - DNA, 1053 bp, Homo sapiens
  Payload ID: 12481
  Gene Symbol: PHOSPHO2
  Gene Name: phosphatase, orphan 2
  Uniprot ID: Q8TCD6
  ENST ID: ENST00000617738
  CDS Start-End: 319-1044
aacaagggaggtgctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctgggaaccagtcagaagcatctggattaggcatttagtgatacaaggatccagaataacaaaaactatgtaccagccacattcacacaacagggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagc

SEQ ID NO: 164911 - DNA, 5597 bp, Homo sapiens
  Payload ID: 12482
  Gene Symbol: PCYT1A
  Gene Name: phosphate cytidylyltransferase 1, choline, alpha
  Uniprot ID: P49585
  ENST ID: ENST00000292823
  CDS Start-End: 174-1277
cccgggcgtctccccgcaacctcctcaacttccctagtcagtgacgcggcgccggccagaaatccgaccggaccgggctcgggggagcgtgagttgcagcatgtgccgaagcgccacctcagaagataaaaagaaatgagtctcatatttggcattcttttagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctaggactgggggaacccaaacagcctgtcctgcaagtgacatcactcacccacacgaaggagggggactgcaccttagaagcctgctctgcatccatttacccccccccaagggctttgtttcactgtttatgttcacgtgatctcaacagggaaattgtcattttcattaattttttaaaaaattcgtctttcaaatgtagaactaattttttgcccctgaggagtgggcagaagaaggaggtagtgtaatacgcagaggccttttcttcccggtatactatagcatttgccttccgttctgaagctatgtggcttgccaagtccttcacgaaatgagccacgctgatgggtaatttgtggagaaatatcttaattttgatttccttaaggaaaagcgaaaagcagagttacagtcacaaatcccctgaacgtactgctgtcaccagtgtcattgtggctgcgggaaggagatctgaacctaacttttcttactccctgaggagtttcttgttggacccaatggggtccatgaagacactgatggggatggaagcagacccatggcatcaactgcagtgtttctgctgtgttcatcttctcagaaaactctgtgacccagttctttgggagcttttgtcagtctctttcgtgccatctaccttcgaaggaaggaacacttttagagttacaatgatgaggagaggagcgggacaatactcaatcctataccaagtcgattgagattagtttcctactgggagtaagtgcctggccctgctactcctatttgaatgctattaatattacctagccttttacaaaggatactttgtaaatgtctgctgttggaacttgatgttaatccattttggtcatagccatattagagagatttgcacagaatgtaaaggcaaaagcataggaaacaccttcctttctaaagcaacagccttatcaccttgacctctgtccctcttcagaacattcttccctggaaccagtgctccacatctttcttttcctctgagagctgcagctggcagggacctccctctgctgctcctccagcaagccacagagcataccctcacgtgacaagagtgtggtaggttttctccccacttttcacacacgcctggtggttgtggttccatctgccttgttggcttgcccggggggattcaacacttgactttcaaatcaaagaatgctaatgcttagcacttgctgttgagcatgctctaacttttaaagccctggcctcctgtctccttagctgcttagctacgcggcctagcagatcatcacccatcagtaatcctgtggctagatccaggggaaaattgcttatgtccaggccccacccctgtcactcataaataccccttgtgggggtggaattttagtgttttcagctaagaaaaccacattttctctttccttgcctctgctaggactgtgagcatctcatagtccactccctaaacactttctggtaacacctagttttccgcctgagggtcagaggctagaatcattgcctgcacagcaggactaccttggttcttaaaacttggatcacccaggcaaggcgtggtggctcacgcctgtcatctcagcactttgggagactgaggctggtggatcacttgaggccacgagtttgagaccagcctgaccaacgtggtgaaaccccatctctactaaaaatacaaaaattagccaggcgtggtggtgggcacctgtaatcccagctacttgggaggctgaggcaggagaatcccttgaacccaggaggcggaggttgcagtgagcagagatggtgccgctgcagtccagcctgggtgacagagcgagactctgtctccaaaacaaaacaaaaaccacacacacatacagaaataaagagaaataatcaactagaaaaaaaacaaaacttggatcacccagaaagagcgtcacagaggcgagggagaatgaagcctcttgttatcctgatcgcctatgacaacgacatttctaactcttctttgaagcgcagttcttactcttaaatctggtcatacaagctttggcttggaatcctgtctgtctttgaaacagctgaagttagtgttttcctgtgttacccagtgttacatagtctcatctttgaacttttctgcgtcagccttctctctttgggaatgctgcctgtttctgtctaacttattctccctggtgtggtgtggcagtgaagtctgtgctgaagcccatctgcttggttcctccaagtgcacattatgcaagtgtatttggatagacagggagatgcccggaacgtggttttcctcctccctccctattggagccatacctcctaaatatattgtctgggtcccaaatgtttgagccctcttcctctgctctcagtgggctgctcttggcatgccctgtgcttggaacgggacctgcaggctgacaggcctctgagactgctagggccagcaaacgtacatgttattgggaaactccctttccccttttggtgagcttctaccacctcagtctaatcgttttgactgaaagctatttgtctgactgaaagctaaaatcttttatagtgtggcctgttagatactttggggtaaatgtggtctgaggtgctggactagcacgggtagatggagaaagctgttgggaagttgcataatgtggtcatctgtgcctaattaaatgaggttagaggtgtgcacaccaccacaatgcctgggatctaaatcttcagatattaacgtttgaggctatggagctgtttccctgaatcacacacgagaaagcagtcaacatgggtgggccaaatgtggccaagatgagagagccagaagtgttggccttagagcagagcctctgtgtgtgagacattagaaggccagagccggggaggtgccggcgcagccactgccttccggtgggccggacggaaagcttggtcttatgctagattcagaagcactgaagaatggaggttgacactttagaggactaggaagggatcatttgtgctcttgcagctattgctgatagctagagccaaagaccattatattgctgaggcttgggtaagaaagttagggatgtgaggaggttgaaaatcctgaagaagagaaaaaatatgagggaggctaaggaaacttagccactttctgatcactgatgactccttaggctgcacctgagtgatggtggtgtttttggaggctgtacctgagtgatggtggtttttggggggctgcacctgagcgatagtgatttttttttggaggctgcacagctggtcagaccatctctagatgttctttccacagtggttcatagggcgtcattcccccttcctggattattttgactatgggtagcttattttcaagagctctttgcctttttaatcctgttccagatcacttatccaaaatctttccaaatcaattatattttgctgcttttctttaattccctaaaagccatagcttctagattttctatcagcacacattctcaccagaagttgaaccaatacaggtagaaaaagaaagcccccttaatgtttttaactgatgatatttttttaagcttaccaatataagtatttttaaaggttctatttttcaaagtcataacaatgattgttcttgttttctctcatagaatagactgccatcggataaagagtggtccctagcttctatttttccaagtaaataagtagaacatgttcttgggattataccattaaatgttaattttcttgaagaagaaagattgttgtctgccaagattttatgttagcgctcggattgaggcagaaaacggaagcaccaggtttaacactgggatgacttgggttgtgttcctggaggtttgaagtgggccttcccgccttttgagggggaaaactgactgttttgaacacatatcctggattagttgggttgttttgtattgaggatccctaaaagacaaaagagtcttggaaaggactgctggcttcgtcttgaacgttcgccccatcaccagtgtgagtccgtggggaagtcttcctcaagtggggttcagtctgtaattttcctgtctgttcttagtttgttctgagttattttggattttgttctttagccaaataaaggcagtgtggttttacctga

SEQ ID NO: 164912 - DNA, 411 bp, Homo sapiens
  Payload ID: 12482
  Gene Symbol: PCYT1A
  Gene Name: phosphate cytidylyltransferase 1, choline, alpha
  ENST ID: ENST00000433733
  CDS Start-End: 1-411
aacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgctatgagccctcctcgtgtggatagtgacacccgacacaccacttcccacacagacctgagttttaaatttggattgacgaaa

SEQ ID NO: 164913 - DNA, 1325 bp, Homo sapiens
  Payload ID: 12482
  Gene Symbol: PCYT1A
  Gene Name: phosphate cytidylyltransferase 1, choline, alpha
  ENST ID: ENST00000419333
  CDS Start-End: 11-1153
ttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcaggtatagttacctggaacagagcaaatttggctcccatgttctgctcacccaggtgtagcctggcttgacgggaaatgatgcccagggtccagagagccagcagtgtggacacgccaaggaaagtgttgatccatagagctgtgctcccctcagaaatctggtggcaacagaaagtagtcagtgaggcaggcaagctctctctctctctctctctctttcaagagatggtg

SEQ ID NO: 164914 - DNA, 555 bp, Homo sapiens
  Payload ID: 12482
  Gene Symbol: PCYT1A
  Gene Name: phosphate cytidylyltransferase 1, choline, alpha
  ENST ID: ENST00000438634
  CDS Start-End: 74-346
gtcagtgacgcggcgccggccagaaatccgaccggaccgggctcgggggagcgtgagttgcagttaaaagaagatggatgcacagtgttcagccaaggtcaatgcaaggaagaggagaaaagaggcgcccggacccaacggggcaacagaagaagatggggttccttccaaagtgcagcgctgtgcagtgtctctccagcctctggaagccactaatctgctttctgattctgtggatttgcctgttctggacattcatacaaatgacatcatacgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgc

SEQ ID NO: 164915 - DNA, 724 bp, Homo sapiens
  Payload ID: 12482
  Gene Symbol: PCYT1A
  Gene Name: phosphate cytidylyltransferase 1, choline, alpha
  ENST ID: ENST00000441879
  CDS Start-End: 87-724
ctcaacttccctagtcagtgacgcggcgccggccagaaatccgaccggaccgggctcgggggagcgtgagttgcagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggggaatgaactccattgcctttgtgtgcaggaagccggaagcacgaccactctttaccctcggcctcattacaagaccaagacctctgcctcggcgcggcagctctcacctggaatcccagcactttgggaggccgaagcggacggatcacct

SEQ ID NO: 164916 - DNA, 549 bp, Homo sapiens
  Payload ID: 12482
  Gene Symbol: PCYT1A
  Gene Name: phosphate cytidylyltransferase 1, choline, alpha
  ENST ID: ENST00000443555
  CDS Start-End: 205-549
acatccgtatcccacttcaaggagacgtcttcgctgcatcctccggttccgggtggaggctgaccctgggccattccgtctccggtctctggtatttctgctgggtcacttcatcccgggggcctctgaggaggcggaactactgtgtcaggagtcgtggttttcaaggagaagtcgtggtcggattgacagagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgat

SEQ ID NO: 164917 - DNA, 1482 bp, Homo sapiens
  Payload ID: 12482
  Gene Symbol: PCYT1A
  Gene Name: phosphate cytidylyltransferase 1, choline, alpha
  Uniprot ID: P49585
  ENST ID: ENST00000431016
  CDS Start-End: 242-1345
atcccgggggcctctgaggaggcggaactactgtgtcaggagtcgtggttttcaaggagaagtcgtggtcggattgacagaggtaggggaagtaggcggaacttccggctggctcttccatcagctgccttccccgggcgtctccccgcaacctcctcaacttccctagtcagtgacgcggcgccggccagaaatccgaccggaccgggctcgggggagcgtgagttgcagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctag

SEQ ID NO: 164918 - DNA, 724 bp, Homo sapiens
  Payload ID: 12482
  Gene Symbol: PCYT1A
  Gene Name: phosphate cytidylyltransferase 1, choline, alpha
  ENST ID: ENST00000444822
  CDS Start-End: 87-491
ctcaacttccctagtcagtgacgcggcgccggccagaaatccgaccggaccgggctcgggggagcgtgagttgcagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagacttttttccagttggggaagatggttgcagtcctaagcagtgggagaagatgggagaggtcggtggctgaggaggtgctaagcaaagaggactccaacacacaatttatgatgtggtgaaccagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatatt

SEQ ID NO: 164919 - DNA, 1084 bp, Homo sapiens
  Payload ID: 12482
  Gene Symbol: PCYT1A
  Gene Name: phosphate cytidylyltransferase 1, choline, alpha
  ENST ID: ENST00000411591
  CDS Start-End: 206-1084
atcagctgccttccccgggcgtctccccgcaacctcctcaacttccctagtcagtgacgcggcgccggccagaaatccgaccggaccgggctcgggggagcgtgagttgcaggtgtgtgcctatctttgcgtctctgtttgagaggacaaactgtggggctgggaccgcgaggtgactgtgactgaggaagagtgttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgttt

SEQ ID NO: 164920 - DNA, 499 bp, Homo sapiens
  Payload ID: 12482
  Gene Symbol: PCYT1A
  Gene Name: phosphate cytidylyltransferase 1, choline, alpha
  ENST ID: ENST00000412869
  CDS Start-End: 99-499
gcggccgcgaggggactccgacccagagcagtgacttcgaggggctgacttggagaagaggatggcatccgtgatgggcgatggcgctttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatga

SEQ ID NO: 164921 - DNA, 798 bp, Homo sapiens
  Payload ID: 12482
  Gene Symbol: PCYT1A
  Gene Name: phosphate cytidylyltransferase 1, choline, alpha
  ENST ID: ENST00000430755
  CDS Start-End: 1-606
gccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgtgagttccagccttaccccagagttccctgactctgtaggagacatatcacctcccactccatctcagctgaactggctttgcagttggctttgatgatcactcccaaaagttcagtgaatgaattaccactatgttaactgttcacaaaaagaatgaaacagacagtttctgccgttacggtctggtaccaacacattcgtataaagccatacagccaactaaataaatgagtaatttatatagtgcagtatttctgtcaataaatggaaaacggtgtctcttaaa

SEQ ID NO: 164922 - DNA, 1289 bp, Homo sapiens
  Payload ID: 12483
  Gene Symbol: PCYT1B
  Gene Name: phosphate cytidylyltransferase 1, choline, beta
  Uniprot ID: Q9Y5K3
  ENST ID: ENST00000356768
  CDS Start-End: 54-1046
gcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaata

SEQ ID NO: 164923 - DNA, 1692 bp, Homo sapiens
  Payload ID: 12483
  Gene Symbol: PCYT1B
  Gene Name: phosphate cytidylyltransferase 1, choline, beta
  Uniprot ID: Q9Y5K3
  ENST ID: ENST00000379144
  CDS Start-End: 132-1241
agaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaata

SEQ ID NO: 164924 - DNA, 5307 bp, Homo sapiens
  Payload ID: 12483
  Gene Symbol: PCYT1B
  Gene Name: phosphate cytidylyltransferase 1, choline, beta
  Uniprot ID: Q9Y5K3
  ENST ID: ENST00000379145
  CDS Start-End: 46-1101
aaagggtagaggcctctagagaagataaaaagatcaggagcaggcatggtaggccatcaggagtgcatcatggaagaggacaatcgcgctccccaattgtggcgcaagaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaatagaggtggcaaagtgcttctgaaatagtcgagaaaaagacagattccaacctcctcagtccagccactgagacctgatgttggaacgcatcagctccttccagttccatgaatgtggctcatagacaaagccttgctttaggctggttataaaaggtcatctagtgtgaaccttaactttttattcaaaggacagttttgtcaagaactccacgtaaggcctgatgtgctcctggttgtactttctcatcactggtttgacttcattgttttgcagaaattaccttaatccgtgggaactgcaacaaagaaaaacttcctaatatataaaaaagaggagctgctttgctttgcctccaggtttagcggacaagaaatgtctcctgaagcttctccttaaaggatgctattatggaatggcttttcccatttctgaccagttaacagtttcatagacctcaagtaacagtttgaggtatcaaacatagtataccaatagggggtgctacctgcacgtatctgttctatatatgctccaatatgtcatccccgggtgtatcccatgtgcaatatgagtatatagtggtggcattttataatagaccccactcctgcgctccaccataatactcctctgaaatccttggtctcaagaaacatctgttctcttgtgacttgggcactttgtcaagcttattccagattcctgtggaaacgttttatcccaaccaggaaattagtattttgttctcgtggcctcctataacatttttgggtgaaggagaactcaagactttttacagagaactgtgggctcagttatgatctcagcatctgaatggtctaggtagtatcaccattatctctggccctaggtttgccaagtaggatgaagactctaagtgttcctgctgagttgtccaaaggtcctgctccttagtcacctgtgcgaaatgagcagggagagttaaggcatagaaccaaactctttgggttattgtatgggtatgccagtaaattcagacacagagctggggtctgactgaatagaggcccaaaccagcaacttgtaggcagagcccagaatctcttgtgatagaaataccccttttcagaggccttgggaaccagccttctaggtgacaaggggacaaccagtgaaggaaggcggcatgtctttccccttcttgttggggttgaactacctccctatccacttggagatgagtgctgtctgctgtgaagcaaaactatgaggctgagctggcttggaacctctttgttcttggcactttccttctccaggactctgggaagcactcatatgggacagagggctggcaggaacatggcatgtgaagaagaaaacttctttttgcagtcaagggccacccagaatattgctcttcagagagggacaagggcctcattcttccatttggtctctgtcttccatcatgcactcaggtcaagccatgcaagtctgcctaccatttgagttagttggcacttgtagcagtgaaggatgaggccagccaggcaagggaaggtggcgggaacaagggaagagaaaaggaggaaagaagttcctggagggaggaaaggaggataaagaaaatctgctctcataaaaccatttcaggacctcactttacaggtgagactctcttgggaaggcctttgtgcccctgctccatggcccagggcagatagattcacttttacctgaatcttatactctggagcaaatagtgtatcaggctgactatacatttgcaggccttacacgccatactgacaggtgccacttacgtgactcatcagataatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaacttttgatactttttggccatctctcagtctctcccagcccctacccccacaccacctccctgctcccaggcagagaccgggttgcactttgttagggccagcaggtcaactgtaatggccaagagtgagttaaggctggaatgagaaatatgccccaagcttggaggggtaagcaggaataacacaaagcaaggaaagagattctttttgccctagtgaggaaaggaagcttcagaatgagggctggaggatagcaacttaggactgcagaagggggcagcttatgaagatgggagaaagtgggactgaagttgtaggggagcaggagggtagtgattttccgcttttctttctttctttcttttactttctttctctttctttctctctctctctctttctttttctttcttctttctctttttctttcctctttttctttctttctttttctttctctttcttccttctttctttcattcttctttgttctttcttctttctttctttttttttttttttgagatggagttttgctcttgttgctcaggctggagtgcaatggcacaatctcggctcactgcagcctccacctcccaggttcaaggggttcttctgcctcagcctcccaagtagctgggattacaggtgcctgccacgacacccagctaatttttgtatgtttagtagagacggggtttcaccatgttggccaggctggtctcaaattcctgacctcaggtgattctcccgcctcggcctcccaaagtgctgggattatgagcacgagccacggcgtccagccgattttccgctccctttcaagtgttaactcaccccctgacaggtgaagagggaagggttccttttacgcacaaccaaggttagcaaatgcccatgcaggatatggggtccctgcctctctggttgcttcatttcagcacttctatattagctgcttatggggaccctaaaatgaactggtcacccctccaccagctaagaaacaagggtgggattgctgtgccataagtcacactgaacgacttgcttctggcaagcatgctcctgtgtgtcaggaccttaccaaggcaaagaaatgccaggctcaagaggagcaggacgtgagacattggcctggcttctaacctggtctgagtggaagagacacagcttagggatttcagttttgctcttaggctactagatactgttatttcaccccctgagggagggacaggaagagcacggatttattttctctccgtcttcagtacttattttagcatctagtcataccccagggagagatgcgagacggtgtcactggctcagctgaagcagatgagcccgtctctagcagagatgtgcctgtttcttaggcatccgttcagcactagtcttggccatcagatttttaaaaaagaaatagctcatgaggcatttgcaacttctcctctctagacttctttctagttttcctctgttgtgtcactgcgatgtgtccagggacaaagccataagtagagcatacatacttaagactatgctgtacatataagacaagacctgtctgggttaaagcacgaccttatgcccaagcatttactctggtgctgaataacgcgaactactggaatcagcctcccccaactctgcgcgccccctgcccccctgctcctatcccattcttgctctcaaatggaccacaccattctcaactcgtttataaataaagggatgcagaattgca

SEQ ID NO: 164925 - DNA, 856 bp, Homo sapiens
  Payload ID: 12483
  Gene Symbol: PCYT1B
  Gene Name: phosphate cytidylyltransferase 1, choline, beta
  ENST ID: ENST00000496020
  CDS Start-End: 12-545
cctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctcccca

SEQ ID NO: 164926 - DNA, 2147 bp, Homo sapiens
  Payload ID: 12484
  Gene Symbol: PCYT2
  Gene Name: phosphate cytidylyltransferase 2, ethanolamine
  Uniprot ID: Q99447
  ENST ID: ENST00000331285
  CDS Start-End: 705-1640
gttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtagctatgacatggtgcattacggccactccaaccagctgcgccaggcacgggccatgggtgactacctcatcgtaggcgtgcacaccgatgctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccagggtagagagacagcctgcccccaccggccctcttgtgtggctacagctgggtgctgggaaggggcctcctactggaggggccgggtgggctggggtccccagtctccccgttgtccttttcctagaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggc

SEQ ID NO: 164927 - DNA, 5147 bp, Homo sapiens
  Payload ID: 12484
  Gene Symbol: PCYT2
  Gene Name: phosphate cytidylyltransferase 2, ethanolamine
  Uniprot ID: Q99447
  ENST ID: ENST00000538936
  CDS Start-End: 110-1279
agcgggtgaggcccgcgtgacggccgctgagcgtgcgcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctcactccgaggccgcctcatttatttattcgtttgccattaactgcggggtgagcggagtaggggagacctggggcgccatcccgcgccggaggggcctggggtcaccgagtgggacggtgggggcggggggcccccagcggtgccaggagaggtccgggctcaggcggcgaggcagtcggctgcgcgcagggacaggaagacgttcgccttgcactggtaggtcccgcggccgtcggggagccgctcgcacctctgcaggtttggggcgacgtcctggacgcacacagcctggggggcaggcaagcaaaggctgaggggccgccgcacccccacccacgtcctgccgccgccccccatcagtccccggcacgccggactcacgaggctccgcagcctggggtgcagttgcagctccggggaggcgccggccccgcccgggggttccgcccctctgtagggctgggagcgccgcgcgtacggggacctgcggaggccggacagcagccccgcggcgcggcccaccgagtaggagctgtgccccgccgctggcttgtaccacgcgaggccaggcggcgccagcagcaggcacagcgccagggcggcggccgccagtgtcgcggaccgggccatggggacgccggctgactggtgggcggcggcgtccgggctcggagcagccaccgcctgggccgccttatatctgcggcgagggcgggccgaggctgcggagggccgggaggggcggcgggcgggctggggtgcagcgggcgcgcgcggaggagccgtcgcacctccgcatcccaaaggaaccagccgcgcgggcgagcgctggaggcgcgcaaggatctggcgcttggtgggagcccaacgccccctcaagctccccacccatgccgctcgcgcccttcaggcccggcttgcgtgggccgcagtggcagcaggggagggcccacgggcgcccagccctaggagtcgtcccccaggcaatccccagtactcctgatgctggagagccagccacactgcacagtgccccgggggcggtttctaccaccctaaggggtattcttggctccaggcatcagagtccatgtggcttgtggggccctcatttctttcatgcccactggggaaggttccaccagcagggctgttactggcggggtcctctgggaggggggcaagaaggccagccacaccaaggcactggagctccacgactcctggccttcgattggaggcccctctctgccagctctgccccttggggggcaccaggcaggactgccagccgctctcctggcaggtgacatcagccttcaagctcactgtgccctcaccatttcatgctcccccaaggtcctggtcatgtcttctcttgggtatcttcccaggacaggcactggcactggagccctggcacttgtttctgggttccatgcttcccaggtgtgatggtgaatgctgagtgtcagcttgactggattgaaggatgcaaagtattgtcactgggtgtgtctgtgagggtgttgccagaggagattcccatttgagtcagtgggctgggagaggcagacccaccctcaatccaggtgggcaccacctaatcggctgccagcacagccaggatacaagcaggcagaggaacgtggaaagactagactggctgaatctggcctccatctttctcccatgctggatgcttcccgccctcgcacgtcggcctccaggttcttcagcttttggactctcggacctacaccagtggcttgccaggggctctgcagcctttggccacaggatgaaggctgcactatcggcttctctacttttgttttgggactcagactggcttccttgctcctcaccttgcacatggcttattgtgggacttcaccttgtgatcacgtgagtcaatactcccaataaactcttcatatata

SEQ ID NO: 164928 - DNA, 1765 bp, Homo sapiens
  Payload ID: 12484
  Gene Symbol: PCYT2
  Gene Name: phosphate cytidylyltransferase 2, ethanolamine
  Uniprot ID: Q99447
  ENST ID: ENST00000538721
  CDS Start-End: 52-1275
gctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagccccctcacccgatacccgccggggacatactttcctcagaaggctgctcccagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgc

SEQ ID NO: 164929 - DNA, 1474 bp, Homo sapiens
  Payload ID: 12484
  Gene Symbol: PCYT2
  Gene Name: phosphate cytidylyltransferase 2, ethanolamine
  Uniprot ID: Q99447
  ENST ID: ENST00000570388
  CDS Start-End: 518-1453
tgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccagggtagagagacagcctgcccccaccggccctcttgtgtggctacagctgggtgctgggaaggggcctcctactggaggggccgggtgggctggggtccccagtctccccgttgtccttttcctagaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccgg

SEQ ID NO: 164930 - DNA, 1028 bp, Homo sapiens
  Payload ID: 12484
  Gene Symbol: PCYT2
  Gene Name: phosphate cytidylyltransferase 2, ethanolamine
  ENST ID: ENST00000573401
  CDS Start-End: 23-157
tccgcgccgccgctgcggggccatgatccggaacgggcgcggggctgcaggcggcgcagagcagccgggcccggggggcaggcgcgccgtgagggtgtggtgcgatggctgccaccgcgctgagatctggagccacggcctccctgcttctccgtaaccaccagcaaccagcttgcccggctccggtccaggggttcccctggcctccgggcgagcgtccctgtagctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagccccctcacccgatacccgccggggacatactttcctcagaaggctgctcccagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccgg

SEQ ID NO: 164931 - DNA, 778 bp, Homo sapiens
  Payload ID: 12484
  Gene Symbol: PCYT2
  Gene Name: phosphate cytidylyltransferase 2, ethanolamine
  ENST ID: ENST00000573927
  CDS Start-End: 534-778
cggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtagctatgacatggtgcattacggccactccaaccagctgcgccaggcacgggccatgggtgactacctcatcgtaggcgtgcacaccgatgctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccaggaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagccca

SEQ ID NO: 164932 - DNA, 575 bp, Homo sapiens
  Payload ID: 12484
  Gene Symbol: PCYT2
  Gene Name: phosphate cytidylyltransferase 2, ethanolamine
  ENST ID: ENST00000572473
  CDS Start-End: 472-575
gtgcgcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccaggaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacgg

SEQ ID NO: 164933 - DNA, 1006 bp, Homo sapiens
  Payload ID: 12484
  Gene Symbol: PCYT2
  Gene Name: phosphate cytidylyltransferase 2, ethanolamine
  ENST ID: ENST00000576343
  CDS Start-End: 64-1006
gcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctgg

SEQ ID NO: 164934 - DNA, 1628 bp, Homo sapiens
  Payload ID: 12484
  Gene Symbol: PCYT2
  Gene Name: phosphate cytidylyltransferase 2, ethanolamine
  ENST ID: ENST00000571105
  CDS Start-End: 59-1162
cggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccaccca

SEQ ID NO: 164935 - DNA, 913 bp, Homo sapiens
  Payload ID: 12484
  Gene Symbol: PCYT2
  Gene Name: phosphate cytidylyltransferase 2, ethanolamine
  ENST ID: ENST00000573636
  CDS Start-End: 56-913
cggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaag

SEQ ID NO: 164936 - DNA, 804 bp, Homo sapiens
  Payload ID: 12484
  Gene Symbol: PCYT2
  Gene Name: phosphate cytidylyltransferase 2, ethanolamine
  ENST ID: ENST00000572995
  CDS Start-End: 1-622
caaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccagtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagc

SEQ ID NO: 164937 - DNA, 1857 bp, Homo sapiens
  Payload ID: 12484
  Gene Symbol: PCYT2
  Gene Name: phosphate cytidylyltransferase 2, ethanolamine
  Uniprot ID: Q99447
  ENST ID: ENST00000570391
  CDS Start-End: 375-1448
ggtgagcgcggggccggggcgggccgcgggggcgccggggccggcttccttccggggcgccgcgccagccgttgcccggggaccgggcccgcgttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtagctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctg

SEQ ID NO: 164938 - DNA, 442 bp, Homo sapiens
  Payload ID: 12484
  Gene Symbol: PCYT2
  Gene Name: phosphate cytidylyltransferase 2, ethanolamine
  ENST ID: ENST00000572157
  CDS Start-End: 283-442
gttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtagctatgacatggtgcattacggccactccaaccagctgcgccaggcacgggccatgggtgactacctcatcgtaggcgtgcacaccgatggaggagagatacaagatggtgcaggccatcaaatgggtggacgaggtggtgccagcggctccctacgtcactacacta

SEQ ID NO: 164939 - DNA, 6172 bp, Homo sapiens
  Payload ID: 12485
  Gene Symbol: PHEX
  Gene Name: phosphate regulating endopeptidase homolog, X-linked
  Uniprot ID: P78562
  ENST ID: ENST00000379374
  CDS Start-End: 566-2815
aagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagctttgtgggaagcctaaattgatgtatcctttaaaagttcaatctattaaacttgtagcctctcaatgatgaagacatgtgcatgaatacctgggagggcttgctgctctgtggaatgcagtgcacgtttttatggacagtaattacacagcattcctcaactgtaaggtagttaaattagaaatatgtttgatctccattttacactttttgatgaagttcttgccttcagctttggagtctgttggaatgaaactgtgtctcacagcttgcatctgatgtagcagattgccctgttcaagtcagcatgaacaaagctcgcagaaaggctactaggtaacggatttgagtttattcagtagaaaaaaagggaatgaggacatatctttaggtcccagaagcagcaaaacctcctagttacataacagcagggaaactaggagatgaaatctccaaaattttgtccagtctgtatgaactgcagtgattgtctgtctgctagacacttttttttagcctaattcttgttcgtttcattaccttcatatgtgtgcattgtactggttttgaaatgagcagacattgagaaaacaattttctgattccccattaggaacatatgattttcatttccctttagtgcaaaggaacaaacatcacattgaggagggagaagtgtacccttctttttcagcttaatgttacctctctttaaaaaaaaaacatttttgaaaaatttcttgactgatgacattctagaatttattgattcaatttaaaattccctgcatagtccaaataaacataatttttactcttcaagtcatctaaagagttgtgagaaagagcagtactatgtgttttatccttagagcattatccttctaagtgaactcctttcttattactgagcgtgtgtgtgtgtgtgtgtgtgtgtgtgtgtgtaggataaaattgtaatggccttaaagttgttacctggcatttttggtttcttaaaataggcatccccctactccctttacattattcattagacatgaggtgctgggttaagtgggccaataggaaaatctcaaaagcaaaatgacaaattcagattaaccacaggaagccattgtgtgtccctgtgatttgtgattcttttaaaaaaaaaaaaaatatatatatatatatatatatatatatatatgtatatctacctaagtgtgtgccatgtccttttgtagccatgggaacgtttgaatggagaaaaatggaggggcaccatcatgaggaaacaattatactgcattagtcagaggagagcgattttccctttgacttcttcctctctgaatggataaacttgtgaagggcagctaccttgtcctcctcttaacctggcttaatgtgaccttagtttgtatttccaaaaacaagcagtattaggttggaattgtatgtgtcttttctctggaggaagcattctgacttggtttagacatataagatactctgttttattcctggacttgggtgtttaaaatcagctgaggtttatcatgcttatatgaatagtgtttcccttctagatttcctttataaactccaaataaacacattcctgcaggtcagagaaagtgtttgataaaagcatagaattatggctttggaaagacaaactaagtcacttgttggtttagcaaaactggttggtgattagttggggccctcacagtttctagatgagaagcttaccttatcctgattaactttacttgctgtaactgttataccgaaaattgtaggtaggatgtccattactcaaacaaagcagaacaaaacaacaaaccaaaagcagcaataccaaatcatcactactagctagaacaatgagaaggattgaatttccaaatacatgcttatgtttaactcaactcttccaattacattctcattgtcctttctcttggataccgattgctaagataaacagacactgattaagtggtagaaagagaaaggtaaaatgcaactggaagggaaagaaaaaagtagggagaagctggcctatggatgtggctttgaagagaagacaggattttggcattccttgctaagcacgttcaatggaggagagccatgaagttttacaaaaataattatggtaaattaaaaggatattagatattggatctcagactagggctgctataatacagttctctgattcgcacaccagatgttctgccagcgaactgttgtctgggcattggaaggagttaggttttttgtgtttgtgaaaatctcctggattagtaaaaaaattttctagatataaagtggttttatttgggctcatgaccattgcccaaagtgtactgagcttttcactaagtgctcagcattggcctcctgttctcatttattcattttatgagatggacttggacatcactaatgcaaacacaggattcataaattattctgaagtttatttagtgccttgcctcaatggagcttaaagcatagcacataaattttatcttatttagccctggagcatcactaagaagcagctaggaactatggcttgccagacagattatgcttgtgccagagaagtggagaagcctgaaatcccttgtcaagtattccacaggaaggaaaggtagtctttgggctttggtctactgacctgtggattaaactctatcccttagattatcccatttctaaatacatttattcaatcagtatttctataatcacttagcatttgataggcttcttccttgatacatttaacataacgcctcagttgcatattacattatggaagaatatacgattgcttcatataacaacattctcatcaccagtgacagtgtcctactggtttgaagaaagatattcttggattatgtgttttatatctaaatggttattctgagactggttgtattttcttctcctactcgtgaaacgatgtgaacaagcattttaaggacaataaaaagttagctggttgaa

SEQ ID NO: 164940 - DNA, 2044 bp, Homo sapiens
  Payload ID: 12486
  Gene Symbol: PCTP
  Gene Name: phosphatidylcholine transfer protein
  Uniprot ID: Q9UKL6
  ENST ID: ENST00000268896
  CDS Start-End: 126-770
agtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttta

SEQ ID NO: 164941 - DNA, 1856 bp, Homo sapiens
  Payload ID: 12486
  Gene Symbol: PCTP
  Gene Name: phosphatidylcholine transfer protein
  Uniprot ID: Q9UKL6
  ENST ID: ENST00000325214
  CDS Start-End: 154-582
ctagcgcaggggcggtgcctccaagtgactgccgtgcagatccaggggagttggaaggtcacaggagttcagcctcagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttta

SEQ ID NO: 164942 - DNA, 2234 bp, Homo sapiens
  Payload ID: 12486
  Gene Symbol: PCTP
  Gene Name: phosphatidylcholine transfer protein
  ENST ID: ENST00000417982
  CDS Start-End: 449-643
tggagctggccgccggaagcttctcggaggagcagttctgggaggcctgcgccgagctccagcagcccgctctggccggggccgactggcagctcctagtggagacctcgggcatcagcatctaccggctgctggacaaggtagcggccaacccgctggaggaccgcggggcctagaatgcgccggggtcgacctccccgcagggagtgcggggcggcagtcgcggaagggacaggggcgcgtcttctccggctcaggaaggagctccgcccggaccctgtctcaagctctggagctagcgcaggggcggtgcctccaagtgactgccgtgcagatccaggggagttggaaggtcacaggagttcagcctcagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagacgtatcctttccacaagcttgtggcgctttccttctgtctgtctacaatgctggcgttggtgtcttgccttaactggctatgcagtatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttt

SEQ ID NO: 164943 - DNA, 2680 bp, Homo sapiens
  Payload ID: 12486
  Gene Symbol: PCTP
  Gene Name: phosphatidylcholine transfer protein
  ENST ID: ENST00000576183
  CDS Start-End: 44-655
ccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctactgactgtcttgttttatttaaggaagccatgcatttcttcctttttaaaaatgaagatagatgtcttctactgcatagagggggagtaaataagacaatatttaggaaaagtcttgcccagtgctcaacattaactaaataataatatatcctgctccttgatccccaatccttaccattttctaattcagtaaagcaagtgctttcatttctttggaagaatgtaacaatccagcccaagcccatttcttgtgttttcttttttccagaaacactgtttcagaaacatcttcgctttttcctagaaaaagctaacatataaggcctttttgcaacagaagttcctgttgactggtcttacttttgtcctcagtcctactttttgtcatcatctgcaacaacattctgttgaaatccagttagggagcctattcatttttgttcgtcctaaagccaacattgtttaccttctgccacatcccaaagaatcaagagtgaccactgtgaagacatagaaatgacagtctcatttcctttgcagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtgg

SEQ ID NO: 164944 - DNA, 919 bp, Homo sapiens
  Payload ID: 12486
  Gene Symbol: PCTP
  Gene Name: phosphatidylcholine transfer protein
  ENST ID: ENST00000573500
  CDS Start-End: 11-670
ctgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatcagagcagaaccaagcgggaagctcagaatcagagagacctcatcaagtttttggcaaacccaaacattctgcaatagattgagtggaaggaagaggaaggacataaagataaagacatgagaaaagaagctgagtctttgttgaaacactgaaatgggtgcaggtatcatttcttatctcattgttttttctcataagccctgaattaattcatttattcacagtattttcgcagatgtgaaattcacatattattcacagatgtgttcactatcatctatgtactggaaagatagcagtgaataaaatggacaaaattacctgcc

SEQ ID NO: 164945 - DNA, 647 bp, Homo sapiens
  Payload ID: 12486
  Gene Symbol: PCTP
  Gene Name: phosphatidylcholine transfer protein
  ENST ID: ENST00000572536
  CDS Start-End: 1-441
cggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaaggctggccttgagctcctgacctcaagcaatccactggcctcggcctctcaaagtgctgggattacaggcatgagccaccacacccggccaatcagagcagaaccaagcgggaagctcagaatcagagagacctcatcaagtttttggcaaacccaaacattctgcaatagattgagtggaaggaagaggaaggacataaagataaagacatgagaaaagaagctgagtctttgttgaaacactgaaatgggtgcaggtatcatttcttatctcattgttttttctcataagccctgaattaattcatttattcacagtattttcgcagatgtgaaattcacatattattcacagatgtgttcactatcatctatgtactggaaagatagcagtgaataaaatggacaaaattacctgcc

SEQ ID NO: 164946 - DNA, 1697 bp, Homo sapiens
  Payload ID: 12487
  Gene Symbol: PEBP1
  Gene Name: phosphatidylethanolamine binding protein 1
  Uniprot ID: P30086
  ENST ID: ENST00000261313
  CDS Start-End: 353-916
tctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaa

SEQ ID NO: 164947 - DNA, 1013 bp, Homo sapiens
  Payload ID: 12488
  Gene Symbol: PEMT
  Gene Name: phosphatidylethanolamine N-methyltransferase
  Uniprot ID: Q9UBM1
  ENST ID: ENST00000255389
  CDS Start-End: 75-785
ggctctataggtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 164948 - DNA, 1050 bp, Homo sapiens
  Payload ID: 12488
  Gene Symbol: PEMT
  Gene Name: phosphatidylethanolamine N-methyltransferase
  Uniprot ID: Q9UBM1
  ENST ID: ENST00000395781
  CDS Start-End: 83-781
acttacccggctctataggtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcccagcacctgcgggagctgtgggatcagaggcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgacccc

SEQ ID NO: 164949 - DNA, 895 bp, Homo sapiens
  Payload ID: 12488
  Gene Symbol: PEMT
  Gene Name: phosphatidylethanolamine N-methyltransferase
  Uniprot ID: Q9UBM1
  ENST ID: ENST00000395782
  CDS Start-End: 68-667
ggcgaggagaggcacaccactattgttttaatttgcttttacctgattcctggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 164950 - DNA, 1008 bp, Homo sapiens
  Payload ID: 12488
  Gene Symbol: PEMT
  Gene Name: phosphatidylethanolamine N-methyltransferase
  Uniprot ID: Q9UBM1
  ENST ID: ENST00000395783
  CDS Start-End: 181-780
ctgaccacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 164951 - DNA, 960 bp, Homo sapiens
  Payload ID: 12488
  Gene Symbol: PEMT
  Gene Name: phosphatidylethanolamine N-methyltransferase
  ENST ID: ENST00000435340
  CDS Start-End: 54-689
ggggcgcgtggctgcagcggggcccgcgtggtgcctcctgaggcggcccccggatgaagagatctgggaacccgggagccgaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcagcccagcacctgcgggagctgtgggatcagaggcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 164952 - DNA, 708 bp, Homo sapiens
  Payload ID: 12488
  Gene Symbol: PEMT
  Gene Name: phosphatidylethanolamine N-methyltransferase
  ENST ID: ENST00000580147
  CDS Start-End: 58-297
tccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccatt

SEQ ID NO: 164953 - DNA, 591 bp, Homo sapiens
  Payload ID: 12488
  Gene Symbol: PEMT
  Gene Name: phosphatidylethanolamine N-methyltransferase
  ENST ID: ENST00000461404
  CDS Start-End: 75-368
ggctctataggtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggtgttggtggctggtgagcctgggctggctgtggggacccttcgcttacaggcaaggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaacttt

SEQ ID NO: 164954 - DNA, 895 bp, Homo sapiens
  Payload ID: 12489
  Gene Symbol: PEBP4
  Gene Name: phosphatidylethanolamine-binding protein 4
  Uniprot ID: Q96S96
  ENST ID: ENST00000256404
  CDS Start-End: 93-776
cccaaagtacttgtgtccgggtggtggactggattagctgcggagccctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaatcatccaggg

SEQ ID NO: 164955 - DNA, 459 bp, Homo sapiens
  Payload ID: 12489
  Gene Symbol: PEBP4
  Gene Name: phosphatidylethanolamine-binding protein 4
  ENST ID: ENST00000522278
  CDS Start-End: 179-459
gggacgacgccggcgccgccgcgctgctgctgggctccagcctcccggccagctcgcggccactcagaaactccggcagggcagcccaggccggacgtgggcccaggagcggacgcgcgcgctgcactgcagccgctgccccttccggatcagcatcgccccgcgcgccaggcgcccaatgtcacggcggcgcgcggagccgggctgcggaggcagcgggcggcgcgcaggggcgccgggagaggggcgaggccgccgccgctacgcgcccgggcccgcggcgaaggcgctgccgcgaagacgcctggcgctgcagtcccaggtgcccatgggttggacaatgaggctggtcacagcagcactgttactgggtctcatgatggtggtcactggagacgaggatgagaacagcccgtgtgcccatgaggccctcttggacgaggacaccctcttttgcca

SEQ ID NO: 164956 - DNA, 2201 bp, Homo sapiens
  Payload ID: 12490
  Gene Symbol: PGS1
  Gene Name: phosphatidylglycerophosphate synthase 1
  Uniprot ID: Q32NB8
  ENST ID: ENST00000262764
  CDS Start-End: 27-1697
agcggaagcggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacggctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcat

SEQ ID NO: 164957 - DNA, 792 bp, Homo sapiens
  Payload ID: 12490
  Gene Symbol: PGS1
  Gene Name: phosphatidylglycerophosphate synthase 1
  ENST ID: ENST00000587356
  CDS Start-End: 1-792
gcggcagctgcggcgggacccgtgttctggaggcgactgctgggcctcctgcctggccgcccagggctggccgcgctcctgggacgcctgtccgaccgcctcggcaggaaccgggaccgccagcgcaggagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcgggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaa

SEQ ID NO: 164958 - DNA, 1944 bp, Homo sapiens
  Payload ID: 12490
  Gene Symbol: PGS1
  Gene Name: phosphatidylglycerophosphate synthase 1
  Uniprot ID: Q32NB8
  ENST ID: ENST00000589425
  CDS Start-End: 18-170
ggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcgggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacggctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcat

SEQ ID NO: 164959 - DNA, 1168 bp, Homo sapiens
  Payload ID: 12490
  Gene Symbol: PGS1
  Gene Name: phosphatidylglycerophosphate synthase 1
  ENST ID: ENST00000589689
  CDS Start-End: 16-1168
aagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctgg

SEQ ID NO: 164960 - DNA, 988 bp, Homo sapiens
  Payload ID: 12490
  Gene Symbol: PGS1
  Gene Name: phosphatidylglycerophosphate synthase 1
  ENST ID: ENST00000592043
  CDS Start-End: 1-988
cggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctct

SEQ ID NO: 164961 - DNA, 572 bp, Homo sapiens
  Payload ID: 12490
  Gene Symbol: PGS1
  Gene Name: phosphatidylglycerophosphate synthase 1
  ENST ID: ENST00000586019
  CDS Start-End: 1-398
acctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggca

SEQ ID NO: 164962 - DNA, 584 bp, Homo sapiens
  Payload ID: 12490
  Gene Symbol: PGS1
  Gene Name: phosphatidylglycerophosphate synthase 1
  ENST ID: ENST00000586355
  CDS Start-End: 1-345
gcgccatcccagcggcctatgtgcacatcgagcgacagttcttcagtgaggtgtgcagcctgggacagcaggagcgggtccagcttcaggagtactggcggaggggctggacgttccacgccaaaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggcagtctgttcactttccatctggtacccactccactaagtcccaaggcgcctgtgctggggtcggca

SEQ ID NO: 164963 - DNA, 1700 bp, Homo sapiens
  Payload ID: 12490
  Gene Symbol: PGS1
  Gene Name: phosphatidylglycerophosphate synthase 1
  ENST ID: ENST00000588169
  CDS Start-End: 5-259
ctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggaatggccttgatgaagatgacaggcatggccggggtcagctctttcagccgcgcttcagcgatgactccagtctgggtgt

SEQ ID NO: 164964 - DNA, 2033 bp, Homo sapiens
  Payload ID: 12490
  Gene Symbol: PGS1
  Gene Name: phosphatidylglycerophosphate synthase 1
  Uniprot ID: Q32NB8
  ENST ID: ENST00000589426
  CDS Start-End: 10-1374
cgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggtggactgcctggaaagtactctagaaaagtcactccaagcaaagtttccttcaaatctcaaggtctccattctcttagacttcacgcggggctcacgaggccggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacggctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcat

SEQ ID NO: 164965 - DNA, 567 bp, Homo sapiens
  Payload ID: 12490
  Gene Symbol: PGS1
  Gene Name: phosphatidylglycerophosphate synthase 1
  ENST ID: ENST00000586510
  CDS Start-End: 18-470
ggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggagatggagtcccactctgtcgcccaggctggagtgcaatggcacgatctcggctcactgcaagctccgcctcccgggttcaagcgattctcctgcctcagcctccggagtagctgggaatacaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaag

SEQ ID NO: 164966 - DNA, 5142 bp, Homo sapiens
  Payload ID: 12491
  Gene Symbol:
  Gene Name: Phosphatidylinositol 3-kinase regulatory subunit beta  [Source:UniProtKB/Swiss-Prot
  Acc:O00459]
  Uniprot ID: O00459
  ENST ID: ENST00000593731
  CDS Start-End: 561-2747
gggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcctccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacgggctggtgcctggtaactactggaaaaattgtagcaattatatttatggttatttcttcaatcccacccggcatagggctattctctctgccttcactgttggggccactgtcctgtgtaggcaccaaggcctgaccatgccatccagaagccccagcctgggacaactctcccccacctgcctctgagccctccatggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagc

SEQ ID NO: 164967 - DNA, 9443 bp, Homo sapiens
  Payload ID: 12492
  Gene Symbol: PIK3C3
  Gene Name: phosphatidylinositol 3-kinase, catalytic subunit type 3
  Uniprot ID: Q8NEB9
  ENST ID: ENST00000262039
  CDS Start-End: 87-2750
cgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacattcttatttatgtacatgttatgagagttctggaggaagtaatatgttgaaatagtaaaacattttagtttttgagtttaaaatgttattttttcctcttatatcttcatatcaggacagcagtaacctgaatttagattgtcacagtttacaagtttttgtttgttccttctttcctctctcttctcccactcacttttgtgtgttgtttgtttttgcctaatttacatgtttaaagttctacttaaaatttttcttcaagttttacatgtgatggctcattcttctgcagttcaagaattgcttatatttttagaagatactcattttctcttacaaataattaattttttgtaaactacagttaatagttcttctagcttgtaagtgtgtaaagtagaatatgaaaatgtggctatttagataactggccaaaaggtcatatgaccaccagttttagtattgagcataagatatttttacatattcatgtaagacaatgtaaattgtctttctgcaataaattttttggatgcaaatttagatttcaaaagctttttgatgttataaaggagttgaggaacaaaaagctctttgaaatagctcacctagacctgttaatgtaatatattctttctgaattaagcaaaattttttttgtcttttaagactagaactaatccctctagcttttttactggaactttggggaaaaagaacaaatacaaatatacaaatgatatgaacaatatggtaataatcttttgcaacttaatatgttacatagtcatatgacttggtcttggaagaaaaagaattgttttggtgctgaataaatattagaaatcaagtgacagagaagatgaaggtaaaattgtggcacagtttcagagaatgccgttaatgataacgtgttatttgtctcaaattcttagccctgggcttgcctcttcagagtggggttaccggcgagagggcaagcatgtaattaagagacactctagaggcatatggaatatagtttgtataaaacatacctgctgattagaaaaatggtaaaaatgaaaatacctttgtacatcatcttaagagagcttatatataaactaaatgggcaggctccatcgtctacctttctttttcttttcttcacatgtttatgtcttttttgttattagtcagacatttttagccctctgtatgctcattcttgtagttctatttctattgaaacttcctccaaaacttttctctgaattacccttgttgaaactgacctttcttccgtgtgaactcctacacttgcatctcctatttcaggatttggcatactttttctttaatgggctaagaaagtaaatatcttcagctttggggggcatatgatcccaatagcatcaacttaactctgctaactggaaggcaaaagtgtatcatcttactcgtctttataaactccacagcactctgcatagatatgaccatgtttataaggaactcaataaataattttgacacaaacatgaaattctagaagggcagacactgacaactagtaaggaagttgatcatgagtaactttgtattcagtgccaccttaacaagaattgtaaagaggataaacctttctaggaaggttgatgcgtgttgggtgaggaaggagcatctctcaggagggtaaacagtagctgtggttttgctgagagattttggctgtgagtgacaagcctatatcaaaaagaaaagtggcttatcaatctcagtttttattgctcaaagcaattctttactcctattttttccaaattccattgtttttactctttagagctctatcctcagagtgtagtctgcatatttctttattatcattgccatgtgacttctttggtgacaagttcagtgatatttcaagcatgatgttttgagtttgagaaatgtatttgtgaggacacatcactttaattaaaaaagtgtgagtactatggtcattaagttattcagagtgagatttctgagaggagaagagagaatgtagatggcagttattgagagtggggctataggacaaaaagaagaaaagtatggttaacattgccaaataaagggtcatacagccttgctttttgctggagttagcaaaaatcattctccatatgatagttttagatgttccccagctcatttgtattattgagttttcagctgggtatatattataataacagtcaacatgatgtaggggctcagtattacatggcagggctatactaattgcttcatatgccttatctcattattctgtgagatagaattgtctcctcattttttagttgaaataactgaagtttaaagcaattgaatcatctgcccaaggataagctgctggtgagagcagagttgggatttgaagtcgagttagaccccagtgatcacagtcttgacgattaaattcttccagctttcatttttcactgagataatggtagtgatagtactgacctctaatgtgtgcatttgtgggtatgtggtccattcagctttaatccccagaagacaaggcttattccttttcttatttttggtcatgttttatttttccattgcttttaacaggattaccaaaggcacactcagtagtcagtaaacacatttctaggaaaggtgttgtgtcatcatgccacatattcatactttccttgggttggaaaatagatcattcagtaaaaacatacaggaaaaatgaatcttgccaatgcaattgttaacctacaaccataatataccttaagtatatttttgcacataagtataacattgcgatttaaaacaataaaccagattgagattctaaggagcattttgtaagtaattactaatgtttattttagagagatcacacaacttcaaataaaaactgacatagattgaacaccttgagaataaactttagtgccaaatggaaaataattttttacaagtaaatttgaagaacaatgtgaactttctataattatatacagaaaatatactgatttgccaaaatgagtaattttgatatattaatatttcacttataagaatgcataccacctgatccaggatgggatccaggaacagaaaaagaacattaggtaaaaatgacagaaatctgaatatagtatagagtagctaaaaacaaaccaaaaaaaaaaaaaaaaaaaaaggaaaaacagaataagcctcagaagatagtgagcatcccacctgggtgaccacttagagaagctgaggtgggacccctgcatccgataagtggctgcactagaccacaggaaccagactccactgtaagaactagagtgggaatggacatgtcaaaacctcctgggaaccttattaaatgtgcacattcccaatccccactcctgagcagccaaatcaatctgcaggtgggccttgtgagttttcccaggggattccgatgcctgctagatttaaccagtagatgagatgttaagttatcctgtagtccagagattccacaggccagtgtcagggaacaggggccagggctgggaaggcataagaacagaagataaatttgaggctctgttacgctggtcatccaacccaaccaggtatctcttgttatatgctaacttcattttccctttcttgtccatagtgggaaaaaataatttttaactggctatgtagttaaaaaacctaacaaaaagcacttttctatataatgagtggtttatattaagaataggtacaatgtaaatactggtaagtgaaagttcattttgttcagtgctatgggctggtacattgcatttcaacactagttttttacttttatctaccctgagggtagataacccatattccaaaatacagtattattttcatttgctgtaacattttaagaaatatgtagtttctaaaacttcatatactttatatggaatatgaacaactttaatatgaataaatagtctagaaaaaaatttaggaaaaattgccatgaaatcatgagctaagtcaatggttattttaaaccacttaattttgagactagtatttcatacagaaaaagctaatactgatatcacacactaattgtgtataaaacactaggaatgtcaaaatagaacataagaaaatgagtctagtggacccactgcatagtgtaactttgggatgaatttaaaagaatatttaagtcacagtcaattttctgttggtctaattttaccaaataaccccctaaataagaagtctgatttatctaaaatagaagttaacatagcatcccagtattgccattctaaaactctggcatgtaaatgggagaaatggaaataagctcaaaatgggtagagtaacccatttctgcatgaaccatagaatttaactagaatttggctggctcatgcctgtaatgccagcactttgggaggccaaggcaggcagatcacttgagcccaggagtttgagaccagcccgggcaacatggtgaaactccatctcttcaaaaatatatatttgtgtgtgtgtgtgtgtgtatgtgcgtgcacaaaaattagctgagtgtggtggttcacacttgtaatcacagctacctgggaggctgaggcaggaggattgcttgagcctgggaggcagaggttgcagtgagctgagattgcaccattgcactgcagcctgggtaatagagcgagacaactctatctcaaaaaaaagaatttcactagaatttatatcttcagtgtttgcattagattgtcaccagcactatctgccttgtgactgtcaggactaatccttatatcatttatcttatgtcctttacctcagtttatgtctgtcaccacaagaaacccagacctccctaatcataccatatgccctggtcttacccacatacagctcggtacaactgcatttccccaaacctcagaactccttgggccatcactgtcagagacatttgaactagagcaactccatcttgagtagggactgggtataatgaagctgagacccactgggctgcattcccaggaagttaggcattcttagtcacaggatgagataggagattggctcaagataaggtcacaaagaccttgctgataaaacagtctgtggtaaagaagccagccaaaacccaccaaaaccaagacgggaatgaaagtgacctccggtcatcctcactgctcattatacgctagttataatgcattgacatgctaagagacactcccaccagcaccatgacagtttacaaatgccataacaacatcaggaagttaccctatatggtctaaaaaggggaggaaccctcagttctgagaatttccttgaaaattcatgaataatccaccccttgtttagcatatgatcaagaaataatcattaaaaaatagccaaccagcagctcatgctgctggtctgcctatggagtagccatcctttctttattaacctgctttcactttatggactcccctgaattcttctgcaggagatccaagaaccctctcttggagtcttaaccaggatccctttccagtaacttcagcaggatctgtgagtgccagtttccttctgtggtgcaaaactaggtgctaagtacactttttcccccctttcctctatttttaaaagaactttcagcccttttgaagtgggtacattgtctggagtacataccctggggttcattgttataggagaatttaggacacagacacacgaggagtttaggagcagaggtttaataggtagaagagaagggaaagagaaacagcttcctctatagatgtctgcactgacaccgtggctttaaggcatggcccatgatgtgtctccgagtggaaaagactggttggtggtgaatgcgccaaattttatagtccggtttgaggaggtggtttctgattggttgcatcatgtatgacgtttgcaaggtgcatgtggaaggctggtcgccccaccctaatcttatgcaaatgggctttccagttgattgggtccatcttgtgtaacacgtggctggcagagaagggaagatgaagccaccatcttgaaaatgtctagtccttagtttctgctggcattcacccatgcaagctgccagcttgtctatgtctgcagctcaactttacaggctgctctttgttagcaaatgatttggagcttcttttcattaaagaaaaaagccttaccgaggactcccatacccttgctttctgcttaagtgatttcttcttaactcctatgtcaattttatacagcatgaaataatgatgtatctataaatgagcctttgcaagattaccatttatcaaagaaaaccagtgatgtttagttaactgtttgtaaaaataaatggttagtagaatgtctaattcaataaatgtttcataaatgagtaaa

SEQ ID NO: 164968 - DNA, 9206 bp, Homo sapiens
  Payload ID: 12492
  Gene Symbol: PIK3C3
  Gene Name: phosphatidylinositol 3-kinase, catalytic subunit type 3
  ENST ID: ENST00000398870
  CDS Start-End: 39-2513
aagttcccgctgtaggtggtacctttgcagacggtgcgatgggggaagcagagaagtttcactacatctatagttgtgacctggatatcaacgtccagcttaagatctggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacattcttatttatgtacatgttatgagagttctggaggaagtaatatgttgaaatagtaaaacattttagtttttgagtttaaaatgttattttttcctcttatatcttcatatcaggacagcagtaacctgaatttagattgtcacagtttacaagtttttgtttgttccttctttcctctctcttctcccactcacttttgtgtgttgtttgtttttgcctaatttacatgtttaaagttctacttaaaatttttcttcaagttttacatgtgatggctcattcttctgcagttcaagaattgcttatatttttagaagatactcattttctcttacaaataattaattttttgtaaactacagttaatagttcttctagcttgtaagtgtgtaaagtagaatatgaaaatgtggctatttagataactggccaaaaggtcatatgaccaccagttttagtattgagcataagatatttttacatattcatgtaagacaatgtaaattgtctttctgcaataaattttttggatgcaaatttagatttcaaaagctttttgatgttataaaggagttgaggaacaaaaagctctttgaaatagctcacctagacctgttaatgtaatatattctttctgaattaagcaaaattttttttgtcttttaagactagaactaatccctctagcttttttactggaactttggggaaaaagaacaaatacaaatatacaaatgatatgaacaatatggtaataatcttttgcaacttaatatgttacatagtcatatgacttggtcttggaagaaaaagaattgttttggtgctgaataaatattagaaatcaagtgacagagaagatgaaggtaaaattgtggcacagtttcagagaatgccgttaatgataacgtgttatttgtctcaaattcttagccctgggcttgcctcttcagagtggggttaccggcgagagggcaagcatgtaattaagagacactctagaggcatatggaatatagtttgtataaaacatacctgctgattagaaaaatggtaaaaatgaaaatacctttgtacatcatcttaagagagcttatatataaactaaatgggcaggctccatcgtctacctttctttttcttttcttcacatgtttatgtcttttttgttattagtcagacatttttagccctctgtatgctcattcttgtagttctatttctattgaaacttcctccaaaacttttctctgaattacccttgttgaaactgacctttcttccgtgtgaactcctacacttgcatctcctatttcaggatttggcatactttttctttaatgggctaagaaagtaaatatcttcagctttggggggcatatgatcccaatagcatcaacttaactctgctaactggaaggcaaaagtgtatcatcttactcgtctttataaactccacagcactctgcatagatatgaccatgtttataaggaactcaataaataattttgacacaaacatgaaattctagaagggcagacactgacaactagtaaggaagttgatcatgagtaactttgtattcagtgccaccttaacaagaattgtaaagaggataaacctttctaggaaggttgatgcgtgttgggtgaggaaggagcatctctcaggagggtaaacagtagctgtggttttgctgagagattttggctgtgagtgacaagcctatatcaaaaagaaaagtggcttatcaatctcagtttttattgctcaaagcaattctttactcctattttttccaaattccattgtttttactctttagagctctatcctcagagtgtagtctgcatatttctttattatcattgccatgtgacttctttggtgacaagttcagtgatatttcaagcatgatgttttgagtttgagaaatgtatttgtgaggacacatcactttaattaaaaaagtgtgagtactatggtcattaagttattcagagtgagatttctgagaggagaagagagaatgtagatggcagttattgagagtggggctataggacaaaaagaagaaaagtatggttaacattgccaaataaagggtcatacagccttgctttttgctggagttagcaaaaatcattctccatatgatagttttagatgttccccagctcatttgtattattgagttttcagctgggtatatattataataacagtcaacatgatgtaggggctcagtattacatggcagggctatactaattgcttcatatgccttatctcattattctgtgagatagaattgtctcctcattttttagttgaaataactgaagtttaaagcaattgaatcatctgcccaaggataagctgctggtgagagcagagttgggatttgaagtcgagttagaccccagtgatcacagtcttgacgattaaattcttccagctttcatttttcactgagataatggtagtgatagtactgacctctaatgtgtgcatttgtgggtatgtggtccattcagctttaatccccagaagacaaggcttattccttttcttatttttggtcatgttttatttttccattgcttttaacaggattaccaaaggcacactcagtagtcagtaaacacatttctaggaaaggtgttgtgtcatcatgccacatattcatactttccttgggttggaaaatagatcattcagtaaaaacatacaggaaaaatgaatcttgccaatgcaattgttaacctacaaccataatataccttaagtatatttttgcacataagtataacattgcgatttaaaacaataaaccagattgagattctaaggagcattttgtaagtaattactaatgtttattttagagagatcacacaacttcaaataaaaactgacatagattgaacaccttgagaataaactttagtgccaaatggaaaataattttttacaagtaaatttgaagaacaatgtgaactttctataattatatacagaaaatatactgatttgccaaaatgagtaattttgatatattaatatttcacttataagaatgcataccacctgatccaggatgggatccaggaacagaaaaagaacattaggtaaaaatgacagaaatctgaatatagtatagagtagctaaaaacaaaccaaaaaaaaaaaaaaaaaaaaaggaaaaacagaataagcctcagaagatagtgagcatcccacctgggtgaccacttagagaagctgaggtgggacccctgcatccgataagtggctgcactagaccacaggaaccagactccactgtaagaactagagtgggaatggacatgtcaaaacctcctgggaaccttattaaatgtgcacattcccaatccccactcctgagcagccaaatcaatctgcaggtgggccttgtgagttttcccaggggattccgatgcctgctagatttaaccagtagatgagatgttaagttatcctgtagtccagagattccacaggccagtgtcagggaacaggggccagggctgggaaggcataagaacagaagataaatttgaggctctgttacgctggtcatccaacccaaccaggtatctcttgttatatgctaacttcattttccctttcttgtccatagtgggaaaaaataatttttaactggctatgtagttaaaaaacctaacaaaaagcacttttctatataatgagtggtttatattaagaataggtacaatgtaaatactggtaagtgaaagttcattttgttcagtgctatgggctggtacattgcatttcaacactagttttttacttttatctaccctgagggtagataacccatattccaaaatacagtattattttcatttgctgtaacattttaagaaatatgtagtttctaaaacttcatatactttatatggaatatgaacaactttaatatgaataaatagtctagaaaaaaatttaggaaaaattgccatgaaatcatgagctaagtcaatggttattttaaaccacttaattttgagactagtatttcatacagaaaaagctaatactgatatcacacactaattgtgtataaaacactaggaatgtcaaaatagaacataagaaaatgagtctagtggacccactgcatagtgtaactttgggatgaatttaaaagaatatttaagtcacagtcaattttctgttggtctaattttaccaaataaccccctaaataagaagtctgatttatctaaaatagaagttaacatagcatcccagtattgccattctaaaactctggcatgtaaatgggagaaatggaaataagctcaaaatgggtagagtaacccatttctgcatgaaccatagaatttaactagaatttggctggctcatgcctgtaatgccagcactttgggaggccaaggcaggcagatcacttgagcccaggagtttgagaccagcccgggcaacatggtgaaactccatctcttcaaaaatatatatttgtgtgtgtgtgtgtgtgtatgtgcgtgcacaaaaattagctgagtgtggtggttcacacttgtaatcacagctacctgggaggctgaggcaggaggattgcttgagcctgggaggcagaggttgcagtgagctgagattgcaccattgcactgcagcctgggtaatagagcgagacaactctatctcaaaaaaaagaatttcactagaatttatatcttcagtgtttgcattagattgtcaccagcactatctgccttgtgactgtcaggactaatccttatatcatttatcttatgtcctttacctcagtttatgtctgtcaccacaagaaacccagacctccctaatcataccatatgccctggtcttacccacatacagctcggtacaactgcatttccccaaacctcagaactccttgggccatcactgtcagagacatttgaactagagcaactccatcttgagtagggactgggtataatgaagctgagacccactgggctgcattcccaggaagttaggcattcttagtcacaggatgagataggagattggctcaagataaggtcacaaagaccttgctgataaaacagtctgtggtaaagaagccagccaaaacccaccaaaaccaagacgggaatgaaagtgacctccggtcatcctcactgctcattatacgctagttataatgcattgacatgctaagagacactcccaccagcaccatgacagtttacaaatgccataacaacatcaggaagttaccctatatggtctaaaaaggggaggaaccctcagttctgagaatttccttgaaaattcatgaataatccaccccttgtttagcatatgatcaagaaataatcattaaaaaatagccaaccagcagctcatgctgctggtctgcctatggagtagccatcctttctttattaacctgctttcactttatggactcccctgaattcttctgcaggagatccaagaaccctctcttggagtcttaaccaggatccctttccagtaacttcagcaggatctgtgagtgccagtttccttctgtggtgcaaaactaggtgctaagtacactttttcccccctttcctctatttttaaaagaactttcagcccttttgaagtgggtacattgtctggagtacataccctggggttcattgttataggagaatttaggacacagacacacgaggagtttaggagcagaggtttaataggtagaagagaagggaaagagaaacagcttcctctatagatgtctgcactgacaccgtggctttaaggcatggcccatgatgtgtctccgagtggaaaagactggttggtggtgaatgcgccaaattttatagtccggtttgaggaggtggtttctgattggttgcatcatgtatgacgtttgcaaggtgcatgtggaaggctggtcgccccaccctaatcttatgcaaatgggctttccagttgattgggtccatcttgtgtaacacgtggctggcagagaagggaagatgaagccaccatcttgaaaatgtctagtccttagtttctgctggcattcacccatgcaagctgccagcttgtctatgtctgcagctcaactttacaggctgctctttgttagcaaatgatttggagcttcttttcattaaagaaaaaagccttaccgaggactcccatacccttgctttctgcttaagtgatttcttcttaactcctatgtcaattttatacagcatgaaataatgatgtatctataaatgagcctttgcaagattaccatttatcaaagaaaaccagtgatgtttagttaactgtttgtaaaaataaatggttagtagaatgtctaattcaataaatgtttcataaatgagtaaa

SEQ ID NO: 164969 - DNA, 533 bp, Homo sapiens
  Payload ID: 12492
  Gene Symbol: PIK3C3
  Gene Name: phosphatidylinositol 3-kinase, catalytic subunit type 3
  ENST ID: ENST00000585528
  CDS Start-End: 1-533
gggcctgttgggagtgagaggcagaaaaggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaaggtaaaaaaagtcatttggaacaggtgcaaagctctgactgatg

SEQ ID NO: 164970 - DNA, 1554 bp, Homo sapiens
  Payload ID: 12492
  Gene Symbol: PIK3C3
  Gene Name: phosphatidylinositol 3-kinase, catalytic subunit type 3
  ENST ID: ENST00000586545
  CDS Start-End: 37-642
gttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaaggtaaaaaaagtcatttggaacaggtgcaaagctctgactgatgtctattgtagtatatataccttgacattatgaactctgtcagatttttaaaaaatctaaatcttaacttttaaataattgttttattgagatataattcacataccataaagttcacccttggaaagcatacagtctgatggtttagtaaatttacagacttgtataatcatcaccactatataattttagaattttttcatcacccctaaaagaaaccgcaccattaacagtcactcccattttctgctccctgcagttagttccaggcaagtactaatctacttactatctgtatggatttgcctgttctggaaatttcatataaatggaatcattcagtatgtgaccttatgtctggaaatctgtcaggtttgaaaatgtggagcgttggtgatattttcaagatgaccacccactttttctggtgacatagccttaaagttgttagtgtaacattctagagaagcttatgccacttggaagtgaagatgactcagacaattaactagtataaagtttctttgtaagcaaatgaagttattacctttttctttcaaaattgttttaatcaagtgttttcacttagaaatataaaaactaaattctattccgtgcattaattgcaacgctgtcatttattttgtgaacttcctttcacaaagcactgtgttagatactgtttaaggatccctttacagttatctgattaggacactttcttgtagttataatacatactttttttttgcaatcttattagtaggagtgcctctttaatgtctggaggaagttttgttgctaagcttttaacagcttgttgcctttacccacatatagaagaaatcttcaagaataagtacttgggttggctaggcttcatgcttcaacacagaatttttgtcaagttcattttgtcttttgtattgctcttttaaggaaaaa

SEQ ID NO: 164971 - DNA, 686 bp, Homo sapiens
  Payload ID: 12492
  Gene Symbol: PIK3C3
  Gene Name: phosphatidylinositol 3-kinase, catalytic subunit type 3
  ENST ID: ENST00000591011
  CDS Start-End: 1-403
ctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagcagaagtgatgctgcgtctgttccaggcaagacagcgtgacagctttggtttcttcacatgttaggaacattaagccatcatgtaagaagtccagctattctgttggagtgaccaagttgaaaaaccacttggagagggagcagcactgagaatacgtggggaaagagaggccctaccaccctggtatcccggctaagcccaccctttatcaccaaggtgttagaaatctcaccaaagctcatcgacaaggacacatggtgaaagtagattggctggatagattgacattta

SEQ ID NO: 164972 - DNA, 2074 bp, Homo sapiens
  Payload ID: 12492
  Gene Symbol: PIK3C3
  Gene Name: phosphatidylinositol 3-kinase, catalytic subunit type 3
  ENST ID: ENST00000589056
  CDS Start-End: 63-377
ttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggtaacaattaatgactaccagtagacatacattgtatatgcccatggtttttacccctgaatctatgtactaacaagataagttgcggcctggcgcggtggctcacgcccgtaatcccagcactttgggaggccaaggcgggtggatcacctgaggttgggagttcgagaccagcctgaccaacatggagaaaccccgtctctactaaacacacaaaatttgccgggcgtggtggtacatgcctgtaatcccaactactcaggaggctgaggcaggagaatcgcttgaacccgggaggcggaggttgcagtgagccgagattgcaccattgcactgcagactaggcaacaagatcaaaacgccatcttagaaaaaaaaaaaaaaaaagatgagttgcgtaattgaagataaatcagagagtcttaaaaattcctttaaatgttaccttggaagaacatttagggaaagtcctttcccttttaagaattgctttagtagtaatcctacagatggtcattttgcccacacttctgtactggaaaatgcctctttttatggaaagccaataatggatacaagtagcttagtctcttactgtatagctctagttagattgttaaaatgtcctttctcttacaaagtgtgcttaattcactttaatatctacctttaattatttgcttttccccttggagttctatgggataatcattctcagtcccctttgtcctgacaactctttagccctatgtatttatctttatgcagacagcttccagacttacagctttttacctcagtccatttcattaacttcaaattgaaatatcgaactgcttacttgaaattgtcattatatatggccagttgtaaaaggttgtcctttcctctactacctgcctaaaacctgtttctcacctcatttttccatttcaatagatagcaacatcacctacccagttgttcaagctctagacctcaaagtcattcttaacatgtctcttggcctcatctcatatactgaacctattagcaaatcttgtctactcctcaactccaaaatagatcatgaagttacccactgtcttcatttttactactttgaccccacttgaagcaaacaatatatgttgcctaaacaatttgaatgaaacctgaaccctttattggggccttgtggcttgtccaggcaggccatttgtctgaatgtcaaaccactcctgcctcagacaagagcctttgttgttttctctttctggaaagttatttattcagatctttgcagggctgactttagttattaagttgaagttctaatggcatctctttagagaagccctttctaactccttgatctgtaataacatatctgccctcttcctccaatgctctctacttattactgtattgtttatagcacttatcactagctgaagttaccttttttgtttaattcaacaactatttattgaacagctagtagatgctgggaataccaaagttaacagaagagacagaaatccttgctctcctagagcttgttgagttcttatcatcatcttctccccttcaggatgcaagttccatgagagcaggaacctttgtccattggggttacccccatgcctctggaccttgaacaccacctagctaaagtgttcaataaatcagtgttgaattaatgatgaataaatacttctgctcttcc

SEQ ID NO: 164973 - DNA, 618 bp, Homo sapiens
  Payload ID: 12492
  Gene Symbol: PIK3C3
  Gene Name: phosphatidylinositol 3-kinase, catalytic subunit type 3
  ENST ID: ENST00000597477
  CDS Start-End: 1-551
cattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggtaacaattaatgactaccagtagacatacattgtatatgcccatggtttttacccctgaatctatgtactaacaaga

SEQ ID NO: 164974 - DNA, 452 bp, Homo sapiens
  Payload ID: 12492
  Gene Symbol: PIK3C3
  Gene Name: phosphatidylinositol 3-kinase, catalytic subunit type 3
  ENST ID: ENST00000587402
  CDS Start-End: 41-352
tttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggaggctgaggcaggagaatcgcttgaacccgggaggcggaggttgcagtgagccgagattgcaccattgcactgcagactaggcaacaagatcaaaacgccatcttag

SEQ ID NO: 164975 - DNA, 4189 bp, Homo sapiens
  Payload ID: 12493
  Gene Symbol: PI4K2A
  Gene Name: phosphatidylinositol 4-kinase type 2 alpha
  Uniprot ID: Q9BTU6
  ENST ID: ENST00000370631
  CDS Start-End: 58-1497
cggccgcgagcgcagtggtgtggagcgcgccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctccagtgtcagggaatggaggctgggctgcgagagtgttgctgccccctgtgtcattcttctaatccaatgtagaaattgtacgtaatgtatttaaatcaacgcaaatgtatgaataacaaatacagttctgaccttttttgtccagtttctttgggggaaggaagacaaagaaggtaggaacggaattttgagggcaaagaaacctgtgtttccatggaattgctgagacgtggctcctggggctatttctccctaataaaggatgatccaggtcctcatttccaaagtcccaatgctctgaaaaccaaaagtattttcataacccatttgaaaccaaacctgacctgaacttacactgataggaagctatgggtaattatgatgtgttccttttagtgtgattctttgttgcagaaatgtcaatatattttatgacatggttccctactagggattatacagtatttgctgactacttcctaagagccaaaaataaaaaatctgaattccaaaa

SEQ ID NO: 164976 - DNA, 3540 bp, Homo sapiens
  Payload ID: 12494
  Gene Symbol: PI4K2B
  Gene Name: phosphatidylinositol 4-kinase type 2 beta
  Uniprot ID: Q8TCG2
  ENST ID: ENST00000264864
  CDS Start-End: 190-1635
ggaggcgcgaggtggggcgcggccggcggcgaggcgggacaaccgctgggcgggcgccaagcgtgcccgtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgtccgccgagctggaccggagccgccccgcggtttcagtaactattggtacttcagagatgaatgcattcttggatgacccagaatttgccgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaaggttgtattttgaatgtaaccaaaagtttacagttttttgtccaaatattaaatttctatttcagggaagaagtgctatatctcctatattgtatttttgtagaaaatttgtattttatgttgttgttagtttaaaaggtaattttacacatgctggaatgactgtaattactctagaattccaagtagaatacaataacttttaatattgagaagaatgttcatgctaattcttcttacattacaaaaggcctttgaggatgcctacgtctgaaattgctcttacgaactttaataaaatagttagctaatagaaaaacaggtaagaataaagcaatgttgccttaatttcaaaagctgctattttagaatttgaataagtactcctaaagtgaccattattagggaccagaaaattatatcttggctaagtaatagaggaccattttggtttttgtacttgagaatatttttggtgaattactttgttgtagtgaggaaaaaacctaagaaatttcccctttttttaaaaaatggaaatattcaattgagacttgaggggaataatagaaaattaaggtagatccccaatattttggaataccaaaattgccttaaaaattcccttctgtttcttacatgggatcaaatacttgagattagtacttcagagtactggccttgttcaatttagtacttcaattagtattaaacttcactaaaaagtaaaccatactccaaattgtatattggattgcattttggggtcctaggtcatacgttcttcaaaattattatgattgtactattgtacttgaaattacagatgttattataattacagtcaaatgtagactatcaggccaaattaaaggggagcatggcagataaccataaagtcatttatatttgattttgaaatgtatttttgtactttattttgaatatcatccatatgtctgacattattggaatttgtaacattgttaatgcactaagtgatttaaattcaattgatgaagatgtgattttacagaagcagaagtttcattttcttgaggcttaaaaccaatgtcaccacttgggcttaactgggtaatttgtggtctaggccttttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctcttccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaattgctactgttttatatcataaaattaaaataccatggtaatatttgcaaaaggtctggccataccagaaaagtacagttgagatagttaagatataaccacaagtcagagtacattggttgtattttgtaaactttcatgaactgaattcttatttaaatagtatggttttttttcaataagtatatttatagtgacaaatgtggtagactaaaggtaataaaaatcattgtcttaagatta

SEQ ID NO: 164977 - DNA, 6752 bp, Homo sapiens
  Payload ID: 12495
  Gene Symbol: PI4KA
  Gene Name: phosphatidylinositol 4-kinase, catalytic, alpha
  ENST ID: ENST00000255882
  CDS Start-End: 88-6396
cggatgcacctacgcctgcgccctgaggtcgggcgctcgcgggccaggagcggggagccggcgggcagcgccgcggctcgtgaggtgatggcggcggccccggcccggggaggcggaggcggaggcggaggcggcggcggctgctccggctccggctccagcgcctcgcggggcttctatttcaacacggtcctgtcactggcccgctccctggcggtgcagagaccagcatccttggagaaggtccaaaagcttctttgcatgtgtccagtggatttccatgggatcttccagttagatgaaagacggagagatgcagtgattgcattgggcatttttctgattgaatctgatcttcagcacaaagattgtgtggttccttaccttcttcgacttctcaaaggtcttccaaaagtgtattgggtagaagaaagcacagctcggaaaggcagaggtgccctcccggttgcagagagcttcagcttctgcttggtaactctgctgtctgatgtggcctatagggatccttcacttagggatgagattttagaggtgcttttgcaggttttgcatgtcctcttggggatgtgccaggccttggagattcaagacaaagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtcagccctgaacgcggcatgccccctcccagttcccctggaggatctgcctttcactactttgaagcctcctgcttgcccgatgggactgccctagagcctgagtactacttttcaaccatcagctccagcttctcagtctctccccttttcaacggtgtcacatataaggagtttaacattccattggaaatgcttcgggaactcttaaacctggtgaagaagatcgttgaggaggctgttctcaaatctttggatgccattgtagccagtgtgatggaggccaaccccagtgctgatctctactacacttccttcagtgaccctctctacctgaccatgttcaagatgctgcgtgacactctgtactacatgaaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtggcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttggaa

SEQ ID NO: 164978 - DNA, 1636 bp, Homo sapiens
  Payload ID: 12495
  Gene Symbol: PI4KA
  Gene Name: phosphatidylinositol 4-kinase, catalytic, alpha
  ENST ID: ENST00000399213
  CDS Start-End: 1-1308
atgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgaggcgctctctgcacaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtggcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaat

SEQ ID NO: 164979 - DNA, 574 bp, Homo sapiens
  Payload ID: 12495
  Gene Symbol: PI4KA
  Gene Name: phosphatidylinositol 4-kinase, catalytic, alpha
  ENST ID: ENST00000449120
  CDS Start-End: 314-574
aaaacatttctcgtctccgtttgacagcacagagaccggcgagtccacaccagccctgccccaggctcacctcggaagaggcgaccccaaccttctcggactcgtacatgagggccagggacctgctggtgctggcggccgtggcctcagccctgcggaggacctcctgccgcaagtactgctgcctgtccgcgggcgcgtcgggcccgtcggggaggtctcgggcgtccctccaaggggccggccgggcgccttcgtcctccccgtcgtcgtcgaacggattgtagcttttagggtccaaaagcttctttgcatgtgtccagtggatttccatgggatcttccagttagatgaaagacggagagatgcagtgattgcattgggcatttttctgattgaatctgatcttcagcacaaagattgtgtggttccttaccttcttcgacttctcaaaggtcttccaaaagtgtattgggtagaagaaagcacagctcggaaaggcagaggtgccctcccggttgcagagagcttcagcttctgcttggtaactctgctgtctgatgtggcctatagg

SEQ ID NO: 164980 - DNA, 3331 bp, Homo sapiens
  Payload ID: 12496
  Gene Symbol: PI4KB
  Gene Name: phosphatidylinositol 4-kinase, catalytic, beta
  Uniprot ID: Q9UBF8
  ENST ID: ENST00000368872
  CDS Start-End: 553-2958
cgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttct

SEQ ID NO: 164981 - DNA, 3340 bp, Homo sapiens
  Payload ID: 12496
  Gene Symbol: PI4KB
  Gene Name: phosphatidylinositol 4-kinase, catalytic, beta
  Uniprot ID: Q9UBF8
  ENST ID: ENST00000368873
  CDS Start-End: 170-2620
gggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcc

SEQ ID NO: 164982 - DNA, 3934 bp, Homo sapiens
  Payload ID: 12496
  Gene Symbol: PI4KB
  Gene Name: phosphatidylinositol 4-kinase, catalytic, beta
  Uniprot ID: Q9UBF8
  ENST ID: ENST00000368874
  CDS Start-End: 474-2879
ccccgcccccttttctatttctgaacaggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcactacatagaagtttgctttttccctgcctgtcttggtcactaccacctcttccctgagaagggcgggccttccatgttctctcacccgcttcaactccacattgtccaagtcacagaaaaagagaggcctgaatggagattcgaccacaaacagttttaatggtctggttttctccctagttccccaactgtttgttagtattattattactacaagaataaaggattcctgagagcctgtc

SEQ ID NO: 164983 - DNA, 3983 bp, Homo sapiens
  Payload ID: 12496
  Gene Symbol: PI4KB
  Gene Name: phosphatidylinositol 4-kinase, catalytic, beta
  ENST ID: ENST00000368875
  CDS Start-End: 582-3068
agattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcactacatagaagtttgctttttccctgcctgtcttggtcactaccacctcttccctgagaagggcgggccttccatgttctctcacccgcttcaactccacat

SEQ ID NO: 164984 - DNA, 566 bp, Homo sapiens
  Payload ID: 12496
  Gene Symbol: PI4KB
  Gene Name: phosphatidylinositol 4-kinase, catalytic, beta
  ENST ID: ENST00000446339
  CDS Start-End: 1-221
ccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgt

SEQ ID NO: 164985 - DNA, 1150 bp, Homo sapiens
  Payload ID: 12496
  Gene Symbol: PI4KB
  Gene Name: phosphatidylinositol 4-kinase, catalytic, beta
  ENST ID: ENST00000438243
  CDS Start-End: 309-1150
aagcgcaggcggccaatggaacccgggagcggtcgctgctgctgaggcggcagtgtcggcagtccaaccgcgactgcccgcaccccctccgcgggggtcccccagagagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgc

SEQ ID NO: 164986 - DNA, 934 bp, Homo sapiens
  Payload ID: 12496
  Gene Symbol: PI4KB
  Gene Name: phosphatidylinositol 4-kinase, catalytic, beta
  ENST ID: ENST00000455060
  CDS Start-End: 1-684
gaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttgtcgccgttgctcaggatcatccccatctggccccatgatgacggtggcccaggtcatctgttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactg

SEQ ID NO: 164987 - DNA, 965 bp, Homo sapiens
  Payload ID: 12496
  Gene Symbol: PI4KB
  Gene Name: phosphatidylinositol 4-kinase, catalytic, beta
  ENST ID: ENST00000430800
  CDS Start-End: 391-965
agccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgaga

SEQ ID NO: 164988 - DNA, 558 bp, Homo sapiens
  Payload ID: 12496
  Gene Symbol: PI4KB
  Gene Name: phosphatidylinositol 4-kinase, catalytic, beta
  ENST ID: ENST00000489223
  CDS Start-End: 273-558
agcctccgcggccgctgtcagggaagcgcaggcggccaatggaacccgggagcggtcgctgctgctgaggcggcagtgtcggcagtccaaccgcgactgcccgcaccccctccgcgggggtcccccagaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggt

SEQ ID NO: 164989 - DNA, 880 bp, Homo sapiens
  Payload ID: 12496
  Gene Symbol: PI4KB
  Gene Name: phosphatidylinositol 4-kinase, catalytic, beta
  ENST ID: ENST00000489889
  CDS Start-End: 1-552
ccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttccc

SEQ ID NO: 164990 - DNA, 2603 bp, Homo sapiens
  Payload ID: 12496
  Gene Symbol: PI4KB
  Gene Name: phosphatidylinositol 4-kinase, catalytic, beta
  Uniprot ID: Q9UBF8
  ENST ID: ENST00000529142
  CDS Start-End: 430-1884
agattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagc

SEQ ID NO: 164991 - DNA, 1958 bp, Homo sapiens
  Payload ID: 12497
  Gene Symbol: PICALM
  Gene Name: phosphatidylinositol binding clathrin assembly protein
  Uniprot ID: Q13492
  ENST ID: ENST00000356360
  CDS Start-End: 1-1899
atgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatcctt

SEQ ID NO: 164992 - DNA, 2340 bp, Homo sapiens
  Payload ID: 12497
  Gene Symbol: PICALM
  Gene Name: phosphatidylinositol binding clathrin assembly protein
  Uniprot ID: Q13492
  ENST ID: ENST00000393346
  CDS Start-End: 150-2108
gcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatc

SEQ ID NO: 164993 - DNA, 563 bp, Homo sapiens
  Payload ID: 12497
  Gene Symbol: PICALM
  Gene Name: phosphatidylinositol binding clathrin assembly protein
  ENST ID: ENST00000528256
  CDS Start-End: 120-563
attttcctgcagctgcctgttcctcttaccctgcccggctccagctgacccgggaagggcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaat

SEQ ID NO: 164994 - DNA, 699 bp, Homo sapiens
  Payload ID: 12497
  Gene Symbol: PICALM
  Gene Name: phosphatidylinositol binding clathrin assembly protein
  ENST ID: ENST00000532041
  CDS Start-End: 166-483
ctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatg

SEQ ID NO: 164995 - DNA, 757 bp, Homo sapiens
  Payload ID: 12497
  Gene Symbol: PICALM
  Gene Name: phosphatidylinositol binding clathrin assembly protein
  ENST ID: ENST00000529016
  CDS Start-End: 1-734
atgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgatacagtttatgtaacttgatggaagaaaatggaatta

SEQ ID NO: 164996 - DNA, 802 bp, Homo sapiens
  Payload ID: 12497
  Gene Symbol: PICALM
  Gene Name: phosphatidylinositol binding clathrin assembly protein
  ENST ID: ENST00000526961
  CDS Start-End: 1-793
cacatcaaagctgcccaatgatctgcttgatttgcagcagccaacttttcacccatctgtacatcctatgtcaactgcttctcaggtagcaagtacatggggagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatgga

SEQ ID NO: 164997 - DNA, 565 bp, Homo sapiens
  Payload ID: 12497
  Gene Symbol: PICALM
  Gene Name: phosphatidylinositol binding clathrin assembly protein
  ENST ID: ENST00000531558
  CDS Start-End: 205-351
atcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaa

SEQ ID NO: 164998 - DNA, 703 bp, Homo sapiens
  Payload ID: 12497
  Gene Symbol: PICALM
  Gene Name: phosphatidylinositol binding clathrin assembly protein
  ENST ID: ENST00000531930
  CDS Start-End: 148-703
cagcaacgtgtcgggttttcggagtagagataaacaaaaccaggtgacatttccaagcctctcaaggaaaggggggaaaaaacctttctgggtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttgg

SEQ ID NO: 164999 - DNA, 3613 bp, Homo sapiens
  Payload ID: 12497
  Gene Symbol: PICALM
  Gene Name: phosphatidylinositol binding clathrin assembly protein
  Uniprot ID: Q13492
  ENST ID: ENST00000526033
  CDS Start-End: 318-2255
ggagcctggcgccgccattttcctgcagctgcctgttcctcttaccctgcccggctccagctgacccgggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccac

SEQ ID NO: 165000 - DNA, 2049 bp, Homo sapiens
  Payload ID: 12497
  Gene Symbol: PICALM
  Gene Name: phosphatidylinositol binding clathrin assembly protein
  Uniprot ID: Q13492
  ENST ID: ENST00000528398
  CDS Start-End: 187-1842
tatgtgtttcctgtcctattccacaccctagagaatgaataccggccagctagtatctaaatttagaatggcagcaacgtgtcgggttttcggagtagagataaacaaaaccaggtgacatttccaagcctctcaaggaaaggggggaaaaaacctttctgggacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaaga

SEQ ID NO: 165001 - DNA, 566 bp, Homo sapiens
  Payload ID: 12497
  Gene Symbol: PICALM
  Gene Name: phosphatidylinositol binding clathrin assembly protein
  ENST ID: ENST00000532603
  CDS Start-End: 1-403
aaataaatctacaaatgttattgtagattctgggggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattggga

SEQ ID NO: 165002 - DNA, 811 bp, Homo sapiens
  Payload ID: 12497
  Gene Symbol: PICALM
  Gene Name: phosphatidylinositol binding clathrin assembly protein
  ENST ID: ENST00000534412
  CDS Start-End: 18-164
gtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcacca

SEQ ID NO: 165003 - DNA, 905 bp, Homo sapiens
  Payload ID: 12497
  Gene Symbol: PICALM
  Gene Name: phosphatidylinositol binding clathrin assembly protein
  ENST ID: ENST00000530542
  CDS Start-End: 1-905
ggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacac

SEQ ID NO: 165004 - DNA, 1153 bp, Homo sapiens
  Payload ID: 12497
  Gene Symbol: PICALM
  Gene Name: phosphatidylinositol binding clathrin assembly protein
  ENST ID: ENST00000529760
  CDS Start-End: 1-925
ggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaa

SEQ ID NO: 165005 - DNA, 548 bp, Homo sapiens
  Payload ID: 12497
  Gene Symbol: PICALM
  Gene Name: phosphatidylinositol binding clathrin assembly protein
  ENST ID: ENST00000525162
  CDS Start-End: 106-548
acttcaggggaagctgtgaaggcagctgcacctcctttgtcaagctgttggtttcaaccacagacacgaggacacacttgagacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgct

SEQ ID NO: 165006 - DNA, 963 bp, Homo sapiens
  Payload ID: 12497
  Gene Symbol: PICALM
  Gene Name: phosphatidylinositol binding clathrin assembly protein
  ENST ID: ENST00000530692
  CDS Start-End: 1-647
tgtttgttggattcactccttctccagttgcacagccacacccttcagctggccttaatgttgactttgaatctgtgtttggaaataaatctacaaatgttattgtagattctgggggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagctgtcggcagcatccagcccctccagtcacagtcctcacagagcttcaggaaaggacccctttgcagagctctctttggaggatttcttataaatcactttagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagt

SEQ ID NO: 165007 - DNA, 3474 bp, Homo sapiens
  Payload ID: 12497
  Gene Symbol: PICALM
  Gene Name: phosphatidylinositol binding clathrin assembly protein
  Uniprot ID: Q13492
  ENST ID: ENST00000532317
  CDS Start-End: 280-2112
ctcttaccctgcccggctccagctgacccgggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaa

SEQ ID NO: 165008 - DNA, 2261 bp, Homo sapiens
  Payload ID: 12497
  Gene Symbol: PICALM
  Gene Name: phosphatidylinositol binding clathrin assembly protein
  ENST ID: ENST00000630913
  CDS Start-End: 150-467
gcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaag

SEQ ID NO: 165009 - DNA, 3652 bp, Homo sapiens
  Payload ID: 12498
  Gene Symbol: PIGA
  Gene Name: phosphatidylinositol glycan anchor biosynthesis, class A
  Uniprot ID: P37287
  ENST ID: ENST00000333590
  CDS Start-End: 143-1597
attggtgctgcggaacagcagggagggactccggctgcagccgcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataattttc

SEQ ID NO: 165010 - DNA, 3626 bp, Homo sapiens
  Payload ID: 12498
  Gene Symbol: PIGA
  Gene Name: phosphatidylinositol glycan anchor biosynthesis, class A
  Uniprot ID: P37287
  ENST ID: ENST00000542278
  CDS Start-End: 121-1575
ggatcgtggcgggtggtggagggggtgaaaccgacccggttcgaagcccggaagttgggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataat

SEQ ID NO: 165011 - DNA, 153 bp, Homo sapiens
  Payload ID: 12498
  Gene Symbol: PIGA
  Gene Name: phosphatidylinositol glycan anchor biosynthesis, class A
  ENST ID: ENST00000475746
  CDS Start-End: 1-153
caaggacatatttttctgaatacctcccttactgaagcattctgcatggcgatcgtggaagcagccagttgtggtttacaggtatatgaccgggtatcagtggaagctgtgttgccaatggacaaacgactggacagacttatttctcactgc

SEQ ID NO: 165012 - DNA, 854 bp, Homo sapiens
  Payload ID: 12498
  Gene Symbol: PIGA
  Gene Name: phosphatidylinositol glycan anchor biosynthesis, class A
  ENST ID: ENST00000634640
  CDS Start-End: 404-854
gactccggctgcagccgcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcggggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggacta

SEQ ID NO: 165013 - DNA, 572 bp, Homo sapiens
  Payload ID: 12498
  Gene Symbol: PIGA
  Gene Name: phosphatidylinositol glycan anchor biosynthesis, class A
  ENST ID: ENST00000635543
  CDS Start-End: 116-572
gggtgaaaccgacccggttcgaagcccggaagttgggtcggagggtctccagagtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacgg

SEQ ID NO: 165014 - DNA, 3246 bp, Homo sapiens
  Payload ID: 12498
  Gene Symbol: PIGA
  Gene Name: phosphatidylinositol glycan anchor biosynthesis, class A
  ENST ID: ENST00000635598
  CDS Start-End: 117-473
gactccggctgcagccgcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgata

SEQ ID NO: 165015 - DNA, 680 bp, Homo sapiens
  Payload ID: 12498
  Gene Symbol: PIGA
  Gene Name: phosphatidylinositol glycan anchor biosynthesis, class A
  ENST ID: ENST00000634286
  CDS Start-End: 1-300
gtcacccatgcttatggaaatcgaaaaggcatccgttacctcaccagtggcctcaaagtctattacttgcctctgaaagtcatgtacaaccagtctacagccacgaccctctttcacagtctgccattgctcaggagtttattggaccagatatcaaagtcccactggaatgtcttaagtgagagagaggataaatcaaagttttccttatccaggctttttggatgtctttttcctgagcctcctcttccaagcctgttttgctctcagtcaggatttaccagcactctgcatgtgtaggcacgctcacctgcttccttctgtagtgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtg

SEQ ID NO: 165016 - DNA, 1092 bp, Homo sapiens
  Payload ID: 12498
  Gene Symbol: PIGA
  Gene Name: phosphatidylinositol glycan anchor biosynthesis, class A
  ENST ID: ENST00000482148
  CDS Start-End: 66-1013
ccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggg

SEQ ID NO: 165017 - DNA, 965 bp, Homo sapiens
  Payload ID: 12498
  Gene Symbol: PIGA
  Gene Name: phosphatidylinositol glycan anchor biosynthesis, class A
  ENST ID: ENST00000634582
  CDS Start-End: 32-784
gcagccgcgggaggtccggacactggcggccatggaactcaccgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgta

SEQ ID NO: 165018 - DNA, 2172 bp, Homo sapiens
  Payload ID: 12499
  Gene Symbol: PIGB
  Gene Name: phosphatidylinositol glycan anchor biosynthesis, class B
  Uniprot ID: Q92521
  ENST ID: ENST00000164305
  CDS Start-End: 292-1956
actaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctca

SEQ ID NO: 165019 - DNA, 1668 bp, Homo sapiens
  Payload ID: 12499
  Gene Symbol: PIGB
  Gene Name: phosphatidylinositol glycan anchor biosynthesis, class B
  ENST ID: ENST00000539642
  CDS Start-End: 1-1668
atgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaataattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctga

SEQ ID NO: 165020 - DNA, 781 bp, Homo sapiens
  Payload ID: 12499
  Gene Symbol: PIGB
  Gene Name: phosphatidylinositol glycan anchor biosynthesis, class B
  ENST ID: ENST00000565502
  CDS Start-End: 1-267
ggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttc

SEQ ID NO: 165021 - DNA, 1812 bp, Homo sapiens
  Payload ID: 12499
  Gene Symbol: PIGB
  Gene Name: phosphatidylinositol glycan anchor biosynthesis, class B
  ENST ID: ENST00000565367
  CDS Start-End: 292-696
actaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctc

SEQ ID NO: 165022 - DNA, 582 bp, Homo sapiens
  Payload ID: 12499
  Gene Symbol: PIGB
  Gene Name: phosphatidylinositol glycan anchor biosynthesis, class B
  ENST ID: ENST00000570059
  CDS Start-End: 20-196
aggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctc

SEQ ID NO: 165023 - DNA, 773 bp, Homo sapiens
  Payload ID: 12499
  Gene Symbol: PIGB
  Gene Name: phosphatidylinositol glycan anchor biosynthesis, class B
  ENST ID: ENST00000566999
  CDS Start-End: 7-773
ccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaaagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtagg

SEQ ID NO: 165024 - DNA, 1447 bp, Homo sapiens
  Payload ID: 12500
  Gene Symbol: PIGC
  Gene Name: phosphatidylinositol glycan anchor biosynthesis, class C
  Uniprot ID: Q92535
  ENST ID: ENST00000344529
  CDS Start-End: 282-1175
gccccggcgccccgaagcgggaaaaaggctgggtgccgccgtcccccagctgcgcaaccctaggaactctcgggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggtctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatcca

SEQ ID NO: 165025 - DNA, 2630 bp, Homo sapiens
  Payload ID: 12500
  Gene Symbol: PIGC
  Gene Name: phosphatidylinositol glycan anchor biosynthesis, class C
  Uniprot ID: Q92535
  ENST ID: ENST00000367728
  CDS Start-End: 1465-2358
cccggaagtgcttggccacagtcgcagccccggcgccccgaagcgggaaaaaggctgggtgccgccgtcccccagctgcgcaaccctaggaactctcgggtaggtgggttccgtgtaacggtcagtgtttccggggctccttttcctctgctgcctcccgcagacccaaggctgagtgaggggcggcggcggaagtgggaggcccacccaaaaagccaaatggggtgccagaagagtgaaggcgcaccctggggtcaccctaccctaccccgtcccctcccagccccactctgcgggcgggcgctgcccttttgggcgtcgcagaccctccaaccccggcggcggccttaagattcccgggctgggatccctgctgcagagggggtaacggtgtctggcttgccaagcaatatttgttgtggtctatcatggaagaaataaagtcgggcaatatgaattttttttttctcaaatttgccggatggctgtggtgtttctgactcttagttttctcattgtgaaaaaggaatgattatcttcttcgatcctctcaagagtttccttgttttgagtagattgatagctctttaaaggatgctaagctcagctaatggaagaagagtctagtttctttgaggctttgattttggttaaactatagagctcatacctttctgtatggtgcagcttactattgtctttggattggtaacttaaaaaatacaaataacatgcctttgagaaccaataaaaactatggatattatccctataaatttacacaaatccagatataagcatgcaatgtgatatacctaagggatatgtgaaccactgagttaagaactgctttagagggagatacaatgtgagacacaggctttgggataagactttggtttgaatcctggctctgctctgttaccttagggcaaagttacttaagcatcttgaatctcagcttttttaccaaagcaggactaatactaacttacaaggtggtgaggattaagtgaaagaagatacataaggcacttagcacatagtaggtactcaataagcgatagctaacagatgtctattattattcaaggaattataattttcaaatctgaaatgcagttttaatgtcccataaggtgactaccacatacatttttctcagacttttagtaaactgagttgatttgactttatctcagtactactcttgacctttcacaactttcgtaggttcacagtctctctttttctaggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggtctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatcca

SEQ ID NO: 165026 - DNA, 1372 bp, Homo sapiens
  Payload ID: 12501
  Gene Symbol: PIGF
  Gene Name: phosphatidylinositol glycan anchor biosynthesis, class F
  Uniprot ID: Q07326
  ENST ID: ENST00000281382
  CDS Start-End: 172-831
ttttgcccgcccctccctttctgcgactggctgttaggcgtgggtctccgccccacagccctgcgcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagattgtggcttcagatgctgcttactgcttcttaaacctttaaggaacattcttaatacactttatagaattctgaggacaggttttgttttctttcaagttttgaactgcttcattacctataaaaggtctgggtatagctgtagcatttcatttgctttctgagagaaatggacagtttccttggccactgaagatgtttctcacgtaattaaacaacagtttatacatcttgatcctattcttttttttacagtgtgtttctttggagttaaaatggctatgatagcctcatcaaaaacagtcttcaatcccttctgggttaaagctgaacattccacatagcagca

SEQ ID NO: 165027 - DNA, 1061 bp, Homo sapiens
  Payload ID: 12501
  Gene Symbol: PIGF
  Gene Name: phosphatidylinositol glycan anchor biosynthesis, class F
  Uniprot ID: Q07326
  ENST ID: ENST00000306465
  CDS Start-End: 104-724
gcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcagatgacagtagaaagaaaacgtagcacttatagatctctccatgtaccctgcagggggcttggtactgtgaaatgagtaacttaatcctgacaaccgtagtgcaaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataataga

SEQ ID NO: 165028 - DNA, 586 bp, Homo sapiens
  Payload ID: 12501
  Gene Symbol: PIGF
  Gene Name: phosphatidylinositol glycan anchor biosynthesis, class F
  ENST ID: ENST00000420164
  CDS Start-End: 1-174
ttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcagaagcagatagcaaggtaatttttgcagcagcggcctgtgttatcaagaaagctcacaaacatcagatttttcgtcttgtatcacaataagataaagctgatatgctaggtaaagcactgtgaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataataga

SEQ ID NO: 165029 - DNA, 737 bp, Homo sapiens
  Payload ID: 12501
  Gene Symbol: PIGF
  Gene Name: phosphatidylinositol glycan anchor biosynthesis, class F
  ENST ID: ENST00000412717
  CDS Start-End: 108-446
gcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatg

SEQ ID NO: 165030 - DNA, 619 bp, Homo sapiens
  Payload ID: 12501
  Gene Symbol: PIGF
  Gene Name: phosphatidylinositol glycan anchor biosynthesis, class F
  ENST ID: ENST00000474980
  CDS Start-End: 473-619
gccgcccgtcgtacctgatggtaggaggcagtagttccccgcttcccttccgcgggagggagagttaggtaagccccgctggacgccctcggcgtctcgcctcacgaggtgcaagctacccccgcgaattgccgaagcagccctgagccttggcgccccgacccgccggcgctcgccgtcagctcagcgccactcttccggcgtgccctgatggacagaccccctttcggatccgagttttcgcctctgtcccccagttttcccttgtcttcaactcccatgctctttgatcctgcctctcagctggttcctcgctgcccacgcttgcgccggcgtaggctcgggcagaatcccgagggacccgggttggggtggggctgccggtgaaggtgcggcgatgcccgcgaaggctcctctgggtgccgctcggaagagccttctctccgctgcgctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggt

SEQ ID NO: 165031 - DNA, 3203 bp, Homo sapiens
  Payload ID: 12502
  Gene Symbol: PIGG
  Gene Name: phosphatidylinositol glycan anchor biosynthesis, class G
  Uniprot ID: Q5H8A4
  ENST ID: ENST00000310340
  CDS Start-End: 116-3043
gacgataaggcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 165032 - DNA, 2787 bp, Homo sapiens
  Payload ID: 12502
  Gene Symbol: PIGG
  Gene Name: phosphatidylinositol glycan anchor biosynthesis, class G
  Uniprot ID: Q5H8A4
  ENST ID: ENST00000383028
  CDS Start-End: 79-2631
cctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaa

SEQ ID NO: 165033 - DNA, 3218 bp, Homo sapiens
  Payload ID: 12502
  Gene Symbol: PIGG
  Gene Name: phosphatidylinositol glycan anchor biosynthesis, class G
  Uniprot ID: Q5H8A4
  ENST ID: ENST00000453061
  CDS Start-End: 107-3058
gcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 165034 - DNA, 3121 bp, Homo sapiens
  Payload ID: 12502
  Gene Symbol: PIGG
  Gene Name: phosphatidylinositol glycan anchor biosynthesis, class G
  ENST ID: ENST00000509768
  CDS Start-End: 873-2315
gaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggtacggacccctccccggcgtctccgctcccctgaccccacatcccctagaagaccttttttctgagcctcgctgctcggatttcttctcggcgctccccggtggtctcttccattatggtccccacctcagaaattttttttaaccgctccagcgtctcttttctgtattcttacaactttgtggcaaccacctctactggccccacttcgaccttccttcctgatcaccacaaagtaagctgtgtccatacctgggatccagcctctccacttctactcgtccagagctcccgcccctttcctgagcagcctttgggtcactccccgttataggcgccctttttgccccctagcacacaacagataagacccctgccgatcccctcgcgttttggtctcttatattcctccaagatgttttccctgcctaggggctaaggcctctctgcgttaggcctcttcctaggcttcacctacccagccatatacagcaagtaaaggcgccctggttctggaccacttgcacacatcgccagccgctgaccatgtaaacgcagagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaaggtacgtacggctggttcctgggagtgtgacgtagtccttctgctcaggttgttcttgttatttcaggctgcctttcgtttaccagactctggttgaacacctggtgtgtgccacgtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcacagaggaacaagcccccccgctgagggggtgtgtgaatcggacagcctcccagcagaggtgtgggagctgcagctgagggaagaagagacaatcggcctggacactcaggagggtcaaaaggagacttggtcgcaccactcatcctgccacccccagaatgcatcctgcctcatcaggtccagatttctttccaaggcggacgttttctgttggaattcttagtccttggcctcggacaccttcattcgttagctggggagtggtggtgaggcagtgaggaagaggcggatggtcacactcagatccacagagcccaggatcaagggacccactgcagtggcagcaggactgttgggcccccaccccaaccctgcgcagccctcatcccctcttggcttgagccgtcagaggccctgtgctgagtgtctgaccgagacactcacagctttgtcatcagggcacaggcttcctcggagccaggatgatctgtgccacgcttgcacctcgggcccatctgggctcatgctctctctcctgctattgaattagtacctagctgcacgcagtatgtagttaccaaaagaataaacggcaataattgagtcctca

SEQ ID NO: 165035 - DNA, 752 bp, Homo sapiens
  Payload ID: 12502
  Gene Symbol: PIGG
  Gene Name: phosphatidylinositol glycan anchor biosynthesis, class G
  ENST ID: ENST00000510235
  CDS Start-End: 680-752
cagtcttggtgagcacgtgaggattcctggggccacgttagtggcacagttcttttggaagatacttgtaagtttacatcagaagctgcgaaattacagattcttctgattaagtaattcttgtgggaggctaagcattaactaaattacgaaaacctcggttagccaagtcatcgcagatgggtccttctatctgcctgctgtgtgcctgcacgtttcctttccagagaagccccggagaggggactttggttggtccccactccagagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtc

SEQ ID NO: 165036 - DNA, 903 bp, Homo sapiens
  Payload ID: 12502
  Gene Symbol: PIGG
  Gene Name: phosphatidylinositol glycan anchor biosynthesis, class G
  ENST ID: ENST00000511448
  CDS Start-End: 94-675
gcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagagaaatcaatgtgatcattgagtgctgtgtctttttcagaacagccttcttgtaggacacatgtagatgccctcagcttcatcatcctgctggttactttaacgctgggtggataataatgtcacgaggcatttggataaagtattaaaaagaggagattgggacatattaatcctccactacctggggctggaccacattggccacatttcagggcccaacagccccctgattgggcagaa

SEQ ID NO: 165037 - DNA, 2387 bp, Homo sapiens
  Payload ID: 12502
  Gene Symbol: PIGG
  Gene Name: phosphatidylinositol glycan anchor biosynthesis, class G
  ENST ID: ENST00000506402
  CDS Start-End: 79-1470
cctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggctgcctttcgtttaccagactctggttgaacacctggtgtgtgccacgtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcacagaggaacaagcccccccgctgagggggtgtgtgaatcggacagcctcccagcagaggtgtgggagctgcagctgagggaagaagagacaatcggcctggacactcaggagggtcaaaaggagacttggtcgcaccactcatcctgccacccccagaatgcatcctgcctcatcaggtccagatttctttccaaggcggacgttttctgttggaattcttagtccttggcctcggacaccttcattcgttagctggggagtggtggtgaggcagtgaggaagaggcggatggtcacactcagatccacagagcccaggatcaagggacccactgcagtggcagcaggactgttgggcccccaccccaaccctgcgcagccctcatcccctcttggcttgagccgtcagaggccctgtgctgagtgtctgaccgagacactcacagctttgtcatcagggcacaggcttcctcggagccaggatgatctgtgccacgcttgcacctcgggcccatctgggctcatgctctctctcctgctattgaattagtacctagctgcacgcagtatgtagttaccaaaagaataaacggcaataattgag

SEQ ID NO: 165038 - DNA, 3019 bp, Homo sapiens
  Payload ID: 12502
  Gene Symbol: PIGG
  Gene Name: phosphatidylinositol glycan anchor biosynthesis, class G
  ENST ID: ENST00000504346
  CDS Start-End: 176-2860
gttattgcttagaggcggctacctggagccggaagcgcggctgcagcagggcgaggctccaggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatat

SEQ ID NO: 165039 - DNA, 2629 bp, Homo sapiens
  Payload ID: 12502
  Gene Symbol: PIGG
  Gene Name: phosphatidylinositol glycan anchor biosynthesis, class G
  Uniprot ID: Q5H8A4
  ENST ID: ENST00000503111
  CDS Start-End: 600-1499
attgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggtacggacccctccccggcgtctccgctcccctgaccccacatcccctagaagaccttttttctgagcctcgctgctcggatttcttctcggcgctccccggtggtctcttccattatggtccccacctcagaaattttttttaaccgctccagcgtctcttttctgtattcttacaactttgtggcaaccacctctactggccccacttcgaccttccttcctgatcaccacaaagagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaaggtacgtacggctggttcctgggagtgtgacgtagtccttctgctcaggttgttcttgttatttcaggctgcctttcgtttaccagactctggttgaacacctggtgtgtgccacgtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcacagaggaacaagcccccccgctgagggggtgtgtgaatcggacagcctcccagcagaggtgtgggagctgcagctgagggaagaagagacaatcggcctggacactcaggagggtcaaaaggagacttggtcgcaccactcatcctgccacccccagaatgcatcctgcctcatcaggtccagatttctttccaaggcggacgttttctgttggaattcttagtccttggcctcggacaccttcattcgttagctggggagtggtggtgaggcagtgaggaagaggcggatggtcacactcagatccacagagcccaggatcaagggacccactgcagtggcagcaggactgttgggcccccaccccaaccctgcgcagccctcatcccctcttggcttgagccgtcagaggccctgtgctgagtgtctgaccgagacactcacagctttgtcatcagggcacaggcttcctcggagccaggatgatctgtgccacgcttgcacctcgggcccatctgggctcatgctctctctcctgctattgaattagtacctagctgcacgcagtatgtagttaccaaaagaataaacggcaataattgagtcctc

SEQ ID NO: 165040 - DNA, 1784 bp, Homo sapiens
  Payload ID: 12502
  Gene Symbol: PIGG
  Gene Name: phosphatidylinositol glycan anchor biosynthesis, class G
  ENST ID: ENST00000504187
  CDS Start-End: 127-687
actgtcgctgcgacgataaggcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggtgtccagcctactgacagcagctttgaagtacatagtgcatttcccaagaaccgtgggtaaagaaaaaagcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaaggtacgtacggctggttcctg

SEQ ID NO: 165041 - DNA, 1420 bp, Homo sapiens
  Payload ID: 12503
  Gene Symbol: PIGH
  Gene Name: phosphatidylinositol glycan anchor biosynthesis, class H
  Uniprot ID: Q14442
  ENST ID: ENST00000216452
  CDS Start-End: 85-651
aagcgggtctggagcgggcgagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatattgaa

SEQ ID NO: 165042 - DNA, 841 bp, Homo sapiens
  Payload ID: 12503
  Gene Symbol: PIGH
  Gene Name: phosphatidylinositol glycan anchor biosynthesis, class H
  ENST ID: ENST00000558987
  CDS Start-End: 1-410
ccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggagtgcagtgacaatcaccactcattgcagcctccacctcccaggctcaagaaatcctcctgcctcagcctcctgagaacttgggactacagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttga

SEQ ID NO: 165043 - DNA, 583 bp, Homo sapiens
  Payload ID: 12503
  Gene Symbol: PIGH
  Gene Name: phosphatidylinositol glycan anchor biosynthesis, class H
  ENST ID: ENST00000558198
  CDS Start-End: 63-314
acggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgagtgccaagccccggctggactgcttgattgaagtatacaggagctgccaggagatcctggcacaccagaaagccacatcaacaagcccatgagccccagcgttcagaaggccagcattgtcttccatgggagatg

SEQ ID NO: 165044 - DNA, 593 bp, Homo sapiens
  Payload ID: 12503
  Gene Symbol: PIGH
  Gene Name: phosphatidylinositol glycan anchor biosynthesis, class H
  ENST ID: ENST00000561303
  CDS Start-End: 44-445
gcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatggtaagtatttaaaagcagaaggtgatttactacctctgcatcttattgaaagatccagtggaaccacatgggatatcccaagtagtacccgtcttccagagtgccaagccccggctggactgcttgattgaagtatacaggagctgccaggagatcctgg

SEQ ID NO: 165045 - DNA, 476 bp, Homo sapiens
  Payload ID: 12503
  Gene Symbol: PIGH
  Gene Name: phosphatidylinositol glycan anchor biosynthesis, class H
  ENST ID: ENST00000559415
  CDS Start-End: 66-476
gagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggag

SEQ ID NO: 165046 - DNA, 499 bp, Homo sapiens
  Payload ID: 12503
  Gene Symbol: PIGH
  Gene Name: phosphatidylinositol glycan anchor biosynthesis, class H
  ENST ID: ENST00000558493
  CDS Start-End: 1-412
gtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatca

SEQ ID NO: 165047 - DNA, 903 bp, Homo sapiens
  Payload ID: 12503
  Gene Symbol: PIGH
  Gene Name: phosphatidylinositol glycan anchor biosynthesis, class H
  ENST ID: ENST00000560722
  CDS Start-End: 66-629
gagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaa

SEQ ID NO: 165048 - DNA, 1049 bp, Homo sapiens
  Payload ID: 12503
  Gene Symbol: PIGH
  Gene Name: phosphatidylinositol glycan anchor biosynthesis, class H
  ENST ID: ENST00000559581
  CDS Start-End: 65-616
agacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggagtgcagtgacaatcaccactcattgcagcctccacctcccaggctcaagaaatcctcctgcctcagcctcctgagaacttgggactacaggtgtgcaccatctcgcctggctaattttttttttttatttttagtagagatgaggtcttgccatgttgcctaggctgatcttgaactcctgagttcaagcaattctcctgcctcagcctcccaaagtgttgggattacaagcatgagccagcatacctggcctcatgcacattttaaagaacacaatcaaatatatagcaacttctgcctataaatcaccattcatctactttgactctgtcagtctactactgtacactttttttagatagaggtaattgatcttacattgtacactattgtgtgtcttgctttgtaaataatttaatatgtatgtatcctacaaaggccattatatttattattttaaataattgtataatatattgaaatatcagtttatttagccactcttgccagcttttaaaatcatgcctgggtttttttgttttgctcttacaaaaaaaaaaaaacacttatcagctggtgcagtggctcatgcctgt

SEQ ID NO: 165049 - DNA, 760 bp, Homo sapiens
  Payload ID: 12503
  Gene Symbol: PIGH
  Gene Name: phosphatidylinositol glycan anchor biosynthesis, class H
  ENST ID: ENST00000561272
  CDS Start-End: 1-548
gcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccaggctgcatggtgcattcattctaagctggcaacccgaccctcctgcttcctgaacagaaccttacctgggccatcagggcagccatctcaagagccaattccttgttgataggaaacctccctgccactatctctctactggtttgagaggcaaggagcagccgttctcggtccgtctcccctttgacttgactgcgaaagtacagcctacaaagaagagaataagaaaccaggactcagcagggattccaaacagggatggggctttctctgggtctgttacctttatttccaaaaagataaagtactcttttcccacta

SEQ ID NO: 165050 - DNA, 594 bp, Homo sapiens
  Payload ID: 12503
  Gene Symbol: PIGH
  Gene Name: phosphatidylinositol glycan anchor biosynthesis, class H
  ENST ID: ENST00000558001
  CDS Start-End: 80-331
ggtctggagcgggcgagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagct

SEQ ID NO: 165051 - DNA, 1926 bp, Homo sapiens
  Payload ID: 12504
  Gene Symbol: PIGK
  Gene Name: phosphatidylinositol glycan anchor biosynthesis, class K
  ENST ID: ENST00000359130
  CDS Start-End: 28-1026
ggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttacgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcaggtattcatcttaaaccattatttgaatagaatactagtctcacagtttgtacatttttttgaaacattgtattaagaggcaaaagttggtgtttgtaaataaaattacacatttatacccagtcttcactttatgtaggctgtatgcttttcagatttatatgtaaaaactatcaatattagtggaaactaagatcatcgttaggattatgttggagctccaaaagacaatcttgctagtggttcagtttgatacttgccacaaaggcctaaaacttttcccataactggctatcccagcgccataattttctgttaggcctcctggtaacattagggaaaggaatgagaagtgtaaaccaggtactgccttggggagtgaattgtatgtgagtgagcagtgagtgagtacagacatttgtaagagagaggaagttgggagacattggttcactttgggtatgtgaattttagaaatacttataatttgttttattttctctgtaaccatttttaaaggtaaaatactttattagaaataaataatgggtcagtcaatagctactttcttgaaatatataatggcatatgttgttagccatgaaactttgttatttgtgattatctgttgctatctattagaaactcatactatagggaacttttttggattgaaaaatggcaatatatacaattacagcaattttcaaaatttcaaagatttgtaattgagcttatgaatgttgtaggaataaattcaaacactggcacaagatgcttttctttgattctagttacaacagtttctttttttttaattgatgtataatatttgtacatatttttggggtacatgtgatattttgatacctgtgtacagtgtttaatgattaaatcagggtaactggaatatc

SEQ ID NO: 165052 - DNA, 4596 bp, Homo sapiens
  Payload ID: 12504
  Gene Symbol: PIGK
  Gene Name: phosphatidylinositol glycan anchor biosynthesis, class K
  Uniprot ID: Q92643
  ENST ID: ENST00000370812
  CDS Start-End: 25-1212
gcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttacgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagctatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaa

SEQ ID NO: 165053 - DNA, 4318 bp, Homo sapiens
  Payload ID: 12504
  Gene Symbol: PIGK
  Gene Name: phosphatidylinositol glycan anchor biosynthesis, class K
  ENST ID: ENST00000445065
  CDS Start-End: 29-934
aggtgcgggaagtctgaagccggtaaacatggccgtcaccgacagcctcagccgggctgcgactgtcttggcaactgtgttgctcttgtccttcggcagcgtggccgctagtcatatcgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagctatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaa

SEQ ID NO: 165054 - DNA, 933 bp, Homo sapiens
  Payload ID: 12504
  Gene Symbol: PIGK
  Gene Name: phosphatidylinositol glycan anchor biosynthesis, class K
  ENST ID: ENST00000487906
  CDS Start-End: 1-84
aagaatatggaactaaatgtgtatggagatgatgtggaagtggattatagaagttacgagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgca

SEQ ID NO: 165055 - DNA, 1137 bp, Homo sapiens
  Payload ID: 12505
  Gene Symbol: PIGL
  Gene Name: phosphatidylinositol glycan anchor biosynthesis, class L
  Uniprot ID: Q9Y2B2
  ENST ID: ENST00000225609
  CDS Start-End: 18-776
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcagatccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactcca

SEQ ID NO: 165056 - DNA, 1257 bp, Homo sapiens
  Payload ID: 12505
  Gene Symbol: PIGL
  Gene Name: phosphatidylinositol glycan anchor biosynthesis, class L
  ENST ID: ENST00000395844
  CDS Start-End: 18-752
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcagatccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacagg

SEQ ID NO: 165057 - DNA, 554 bp, Homo sapiens
  Payload ID: 12505
  Gene Symbol: PIGL
  Gene Name: phosphatidylinositol glycan anchor biosynthesis, class L
  ENST ID: ENST00000581006
  CDS Start-End: 19-471
cagtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctgaaagacagagcaaattccagattgtgagcagccacctgcatcctctatgcctgagcggcccagccatgagagccagccgaccccacagatgatgcccctttcagcaccat

SEQ ID NO: 165058 - DNA, 582 bp, Homo sapiens
  Payload ID: 12505
  Gene Symbol: PIGL
  Gene Name: phosphatidylinositol glycan anchor biosynthesis, class L
  ENST ID: ENST00000584797
  CDS Start-End: 18-582
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagagagctgccctcagccgagcagaggcagtggttggggag

SEQ ID NO: 165059 - DNA, 550 bp, Homo sapiens
  Payload ID: 12505
  Gene Symbol: PIGL
  Gene Name: phosphatidylinositol glycan anchor biosynthesis, class L
  ENST ID: ENST00000470116
  CDS Start-End: 12-449
gcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagattgtcatatctcagactgatgtgtctatcagaggcacagggacctcaacagcacacgccagtgagtcagtcatcagattatagtagcctgggaatggggtgaatacaggcttgaagtggactagtatctatttccaaggaggcccaatctattgggttggagtgcaacggtgcgatctcggctcactgcaacctccgcttccc

SEQ ID NO: 165060 - DNA, 1345 bp, Homo sapiens
  Payload ID: 12505
  Gene Symbol: PIGL
  Gene Name: phosphatidylinositol glycan anchor biosynthesis, class L
  ENST ID: ENST00000585034
  CDS Start-End: 8-313
acccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaaggtaaggcttgttccttttgcaaagggccacaagatactgtccctctgagaaacttatgagggggaaatttgcaaatccacagagagctgccctcagccgagcagaggcagtggttggggaggccgccacactcttcctgactcacctcaaggtacctggcaggttgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtctgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcaca

SEQ ID NO: 165061 - DNA, 518 bp, Homo sapiens
  Payload ID: 12505
  Gene Symbol: PIGL
  Gene Name: phosphatidylinositol glycan anchor biosynthesis, class L
  ENST ID: ENST00000596678
  CDS Start-End: 1-309
gtggtgactttcgatgcagggggagtaagtggccacagcaatcacattgctctgtatgcagctgtgagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcagatccaaggaacaaaggggaaaatagacaaaggagtgcagaggacctggcctggcactggcttatttacctgagctcaaggagatccccgctggagcagcctctgcaaaagggagcccatatcacacaaaagttgggaagagaaggatgtcaattagactacatcaaaatctgggcagagggaggacaaagagctgcct

SEQ ID NO: 165062 - DNA, 888 bp, Homo sapiens
  Payload ID: 12505
  Gene Symbol: PIGL
  Gene Name: phosphatidylinositol glycan anchor biosynthesis, class L
  ENST ID: ENST00000463810
  CDS Start-End: 1-278
tgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcagttttccgtagggagctaagtgaatacaccgaaggtcttacctctgaacccctcacagcctagggacaggagcggccggcttacctggtgggttgggggacgtcggcagctcgcgtactacgccagcaggattgaggagcagagaaacagttgcagttggttgtattcagtacctgcatttccgttgggaactccacctgtacttgttattctgtggaacttttttttatttgtagaaggagcaagaatattgaccttactatatagcacacgaaacaatctatgctgtatcgtgcctgctcaatccttaaagttaacttctaatgatagtaaaagaccttcctgctgcctttaaaatgcagcttgtgctagtaacatgcatgtgtcaaattgaagaattagacatagatgactagatagaaagtaattttgtaggtaattttagagttcaactccacccagctttcagtgaaggaacctttcaaataatagatttttgcttaccatagagaaaagatcaaatgacaaagcaaatattgaccattaagctggaatatggtgataattgaacagttgtataaatgaagtaattgaattgtacacatacaatgggtgaattttatggcatgtcaaagtatacctcaataaagctatttttttaaattgcccatga

SEQ ID NO: 165063 - DNA, 4319 bp, Homo sapiens
  Payload ID: 12506
  Gene Symbol: PIGM
  Gene Name: phosphatidylinositol glycan anchor biosynthesis, class M
  Uniprot ID: Q9H3S5
  ENST ID: ENST00000368090
  CDS Start-End: 253-1524
cggaagcgagaccgtccatccagaggaaggcaagtttttggctcgggcggctgagaagaccgcgcggggctggagacaggtagcagtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatggaaaggctgatgaaactatcagatactaaaacattcttaaaatagaggaatatagttagagacatcaggtttaagccagtatttgttcctgttttacaatgcttctgtcttaagctgtgtcttaacttttaacacccatcttttctttctaaagctttcctgacagctgtgaaaatccaaaaaatattcttaaactgtgtatggtggcccttgcctgtagtctcagcactttgggaggctgaggtgggagggtcgcttgagttcaggagttctagacccacctggggcaagatggtgagacctagtctcaaaaaaaaaaaaaaaaattagccaggtgttgtggtgcacccctgtagtcatagctgcatgggaggctgaggtgggagaattgcttgagcccagagcaagaccctgtctcaaaaaaaaaaaaaaaaaaaaaaaggaaaggacaactttttagatagaaaagtattaaataatactaagatgcttagtagtattattttagagagttttaaacttctatattaaatgtggggtcttacaagataatccaaagactttgggaggccaaggcgggcagatcacgaggtcaggagattgagaccatcctggctaacacggtgaaacccctctctactaaaaatacaaaaaattagccgggcgtggtgggtgcctgtagtcccagctactcctcgggaggctgaggcaggagaatggcgtgaactccggaggtggagcctgtagtgagccgagatggcaccactgcgctccagcctgggcgacagagcaagactccatatcaaaaaaaaaaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatatttctgggggaaaaatgctttctgagttgtttaaacaagcatccttacatttttttttttaattaaacagcctgtctaggcttgggattccctaatactacagtagcagtatatgaatatgattttgtgattgtgttttttaaaagataagtaatttgatgaactgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggacaatgaccttccttataacatttagtttcatacccatattaggtcttgtcttgaggaccctttatatgtgcttgtttactagtggccttccagccatagcattcttacctttttttcctattctaagaattaaaaaaaaaaattatagagccagcaagggaggaggcaggaaacagaaatcgaatttcatcattccagtatagttgtccctttttttgtatttctgacttggttttataattatatttacttactaattattgttttttaacattctttattgtggcttactcttcatacttagaattgaaattgttggacatcacatgtatattcacattataaatacatcattcttccactgttagacctttagattgcttccagtttttaatattctaaataagactttcaacattttctgtgttttagctcattctcttaggacattcttagaagttagaaacatttctgctgggatcgttggagggaacttcaaactttggaatctttcctgcaagaaattctttaccaaagaaaggcaggtgtttcttaaagggatgcaaaagatattttgcactttgtatgttccaaaacatttagtaagttaactaaaaaaatgagttaatttggtttcttgggggattttaattttttaatttgttttctggttatgtaaaaaaaatgttttttttttgcttcttatcacaatccttttgtttcctttttaatcctttaataacaccttcaaattttataa

SEQ ID NO: 165064 - DNA, 5501 bp, Homo sapiens
  Payload ID: 12507
  Gene Symbol: PIGN
  Gene Name: phosphatidylinositol glycan anchor biosynthesis, class N
  Uniprot ID: O95427
  ENST ID: ENST00000357637
  CDS Start-End: 417-3212
aggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaagggtgctcagtttttttatctttctttattttgctctttgaggcatatctttttcttaattttgtcctttcaggtcagtgtgagtctgtagaataggttgaacttccttctgacagtatcatagagtttgtggagtttgtgttgtgtgcctgcagccacaggctcgccttgctgcaccgtaactggccccttcagactcacatgggaacaagccttttctgttgcagtttcccagatatctttaaatgttttgaaatgtatatttttatgttgcaaaacagaaaaaagaaacgagttagggaaaaagtatttctatttaaggtatttattttttcattctacctatgccatagatttctgaatcaagacttaggacatttgctgattaacaatgtttaaattaggaattgttataagaattaaaataggcagaacaagttgtgaaaatattgaaccaaaaaaaggccatgctatcatcttagagggcccatgaataaaccttagagggaatcctaaggctttaggaaaccgctgcagcttgtctgtcattttccaatatgttaattattatacttagtgtacagtatttagaatacaaaatgcttttttattttttaggaaaataatgttataaatgattgtatattttcatagtaa

SEQ ID NO: 165065 - DNA, 4456 bp, Homo sapiens
  Payload ID: 12507
  Gene Symbol: PIGN
  Gene Name: phosphatidylinositol glycan anchor biosynthesis, class N
  Uniprot ID: O95427
  ENST ID: ENST00000400334
  CDS Start-End: 354-3149
agcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagtcagaaatcagtttggcaaagtgtactttcttaatttctatttatgatgaagtatagtcataatttatttgtaat

SEQ ID NO: 165066 - DNA, 558 bp, Homo sapiens
  Payload ID: 12507
  Gene Symbol: PIGN
  Gene Name: phosphatidylinositol glycan anchor biosynthesis, class N
  ENST ID: ENST00000590765
  CDS Start-End: 139-558
aattatcgcgatagcagcagcggccgggcagaaacagtattatgtctcagtcctgtgcaaagtgagatgagctgtagcctttggagacctataattttgaacatagatgttccttaaaagctaaatctttttgaacagatgatgataaacctggaagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacg

SEQ ID NO: 165067 - DNA, 582 bp, Homo sapiens
  Payload ID: 12507
  Gene Symbol: PIGN
  Gene Name: phosphatidylinositol glycan anchor biosynthesis, class N
  ENST ID: ENST00000590948
  CDS Start-End: 1-431
tgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgattctcaaagagtgtatttgaagcatcacaaccaaccatcaagcatttttctggggattcctgctttgcattcttcttaggatgggtgcaggcttgctggttcttctgttatccctgtgtgttgtaacatctctcatgaaaagaaaagatagctttataaaggaagagctat

SEQ ID NO: 165068 - DNA, 559 bp, Homo sapiens
  Payload ID: 12507
  Gene Symbol: PIGN
  Gene Name: phosphatidylinositol glycan anchor biosynthesis, class N
  ENST ID: ENST00000589339
  CDS Start-End: 280-559
gcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaat

SEQ ID NO: 165069 - DNA, 597 bp, Homo sapiens
  Payload ID: 12507
  Gene Symbol: PIGN
  Gene Name: phosphatidylinositol glycan anchor biosynthesis, class N
  ENST ID: ENST00000585344
  CDS Start-End: 332-597
acgactcctccatgattggtcagagaaggaaggcgtggagcggactgacgggagactggcccgagaattatcgcgatagcagcagcggccgggcagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacg

SEQ ID NO: 165070 - DNA, 565 bp, Homo sapiens
  Payload ID: 12507
  Gene Symbol: PIGN
  Gene Name: phosphatidylinositol glycan anchor biosynthesis, class N
  ENST ID: ENST00000588571
  CDS Start-End: 216-565
gcggactgacgggagactggcccgagaattatcgcgatagcagcagcggccgggcagaaacagtattatgtctcagtcctgtgcaaagtgagatgagctgtagcctttggagacctataattttgaacatagatgttccttaaaagctaaatctttttgaacagatgatgataaacctggaagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaa

SEQ ID NO: 165071 - DNA, 674 bp, Homo sapiens
  Payload ID: 12507
  Gene Symbol: PIGN
  Gene Name: phosphatidylinositol glycan anchor biosynthesis, class N
  ENST ID: ENST00000587134
  CDS Start-End: 575-674
agcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaaggttattttgccatcctttccttccatgatgtgattcttcaggccaagaagaaaaagatgtgtctgtagctaaaattacctcatccttggtgtttttcagcctaggatcactatatgtagctaatgccgttacattacaactaagacaagttccaatacttttttttttctcctcgatctgcagagattcaccaacaatagcaaattacacactggcttggaaagtactcccatactaattagttacactggatatgctgctgttctttactttgggattgcttatacattttgtgttcttcgcctccatctttgacatttattttacatctcctttggttcatggaatgactc

SEQ ID NO: 165072 - DNA, 576 bp, Homo sapiens
  Payload ID: 12507
  Gene Symbol: PIGN
  Gene Name: phosphatidylinositol glycan anchor biosynthesis, class N
  ENST ID: ENST00000591238
  CDS Start-End: 211-576
agcaaattcatgctgctgcattcagctggtagatgctaggaatgggctcacctggaatttgaaaaattcctttccttcttaagttttgacttaagttttttgcttttgattccttctgtaataatcttatgtttctaaagctttatgtgagagtatctaatcatagtctgtgttaactatttgtctttaatatcttttaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaata

SEQ ID NO: 165073 - DNA, 538 bp, Homo sapiens
  Payload ID: 12507
  Gene Symbol: PIGN
  Gene Name: phosphatidylinositol glycan anchor biosynthesis, class N
  ENST ID: ENST00000585458
  CDS Start-End: 286-538
aggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgcta

SEQ ID NO: 165074 - DNA, 446 bp, Homo sapiens
  Payload ID: 12507
  Gene Symbol: PIGN
  Gene Name: phosphatidylinositol glycan anchor biosynthesis, class N
  ENST ID: ENST00000592803
  CDS Start-End: 1-89
ggatacgtgggtttttgataatgttaaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaa

SEQ ID NO: 165075 - DNA, 335 bp, Homo sapiens
  Payload ID: 12507
  Gene Symbol: PIGN
  Gene Name: phosphatidylinositol glycan anchor biosynthesis, class N
  ENST ID: ENST00000586566
  CDS Start-End: 1-335
cagaagaaagaagttactttaccatttttgtttacaccatttaaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatggg

SEQ ID NO: 165076 - DNA, 584 bp, Homo sapiens
  Payload ID: 12507
  Gene Symbol: PIGN
  Gene Name: phosphatidylinositol glycan anchor biosynthesis, class N
  ENST ID: ENST00000588748
  CDS Start-End: 36-584
aaattcatgctgctgcattcagctggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacc

SEQ ID NO: 165077 - DNA, 447 bp, Homo sapiens
  Payload ID: 12507
  Gene Symbol: PIGN
  Gene Name: phosphatidylinositol glycan anchor biosynthesis, class N
  ENST ID: ENST00000589098
  CDS Start-End: 1-312
ccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggtttgtgctattgagtggttaatatacaaaaagcatatttttacctgaagtattggagactgtatcccacgttttttctgttttcatgagctttgaaagttctatgttgtagcacactgttctgaattctaagatttaattctaaaaaattacacattctaaataaataagagaagttttaaa

SEQ ID NO: 165078 - DNA, 635 bp, Homo sapiens
  Payload ID: 12507
  Gene Symbol: PIGN
  Gene Name: phosphatidylinositol glycan anchor biosynthesis, class N
  ENST ID: ENST00000585923
  CDS Start-End: 58-635
cgcgatagcagcagcggccgggcagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaacca

SEQ ID NO: 165079 - DNA, 549 bp, Homo sapiens
  Payload ID: 12507
  Gene Symbol: PIGN
  Gene Name: phosphatidylinositol glycan anchor biosynthesis, class N
  ENST ID: ENST00000585926
  CDS Start-End: 300-549
actttgggaggccgagccgggcggatcacgaggtcgggagttcgagaccagcctgaccaacatgaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggg

SEQ ID NO: 165080 - DNA, 811 bp, Homo sapiens
  Payload ID: 12507
  Gene Symbol: PIGN
  Gene Name: phosphatidylinositol glycan anchor biosynthesis, class N
  ENST ID: ENST00000589720
  CDS Start-End: 246-811
gagaattatcgcgatagcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgc

SEQ ID NO: 165081 - DNA, 2588 bp, Homo sapiens
  Payload ID: 12508
  Gene Symbol: PIGO
  Gene Name: phosphatidylinositol glycan anchor biosynthesis, class O
  Uniprot ID: Q8TEQ8
  ENST ID: ENST00000298004
  CDS Start-End: 166-2184
cctgcggcttcgatccctttccactgggtattgagattggcgaggggagaggcgcagaaacggcgtactctagtgcagtggttcaatctcggctcactgcaacctccgcctccccgattcaagcgattctcctgcgtcagcctccccagtagctgagactacaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataatta

SEQ ID NO: 165082 - DNA, 2464 bp, Homo sapiens
  Payload ID: 12508
  Gene Symbol: PIGO
  Gene Name: phosphatidylinositol glycan anchor biosynthesis, class O
  Uniprot ID: Q8TEQ8
  ENST ID: ENST00000361778
  CDS Start-End: 43-2061
cgcaggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataatt

SEQ ID NO: 165083 - DNA, 4066 bp, Homo sapiens
  Payload ID: 12508
  Gene Symbol: PIGO
  Gene Name: phosphatidylinositol glycan anchor biosynthesis, class O
  Uniprot ID: Q8TEQ8
  ENST ID: ENST00000378617
  CDS Start-End: 396-3665
ctcccgagaacctcaccccccggtattcccctcaccctgaagtaagggagtctccctcttcccctcagctcctaaccaaggtgctcagtaccgcggctagggtgcccagcgggaggctgggtagttaccggaggaggcagagccggtcgcacgcctgggtcccagcggaggcccagtcgactctcgacccgggccccagcctccttgcgtggcgaaggtcgtgcctcaggtctcctggcgaacctggccgcccggaagcggagagtgactcctccccttcgtcccctcggtgcccgccaggcggcgccgtcggctgggcccggattcccctgcggcttcgatccctttccactgggtattgagattggcgaggggagaggcgcagaaacggcgtgatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgcttgagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataa

SEQ ID NO: 165084 - DNA, 6998 bp, Homo sapiens
  Payload ID: 12509
  Gene Symbol: PIGP
  Gene Name: phosphatidylinositol glycan anchor biosynthesis, class P
  Uniprot ID: P57054
  ENST ID: ENST00000360525
  CDS Start-End: 182-586
cacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccatatagcagacttaaaaaaaaaaatcaatgtcagtataatcaagaagttcctccagagaggcatttatattgtaatttgcaaagggcaatgatgtccttcctcctgtttgtcctgaggggcccagaattcaaacccttagtttttgggaagggtacagttagtacttgtgccatcagattcatgtctaagacacaaatatttgttgagtactcactgtgtaccaggtatttttctaggcactgaggatgaagtaatggtaagattctctctcaaagagcttatagttttagaagcagggtgaggcaactaagcaaataaacaaggaaatataatttgatgagtgctatgcaaagaattaagataatgtattctagaatgcaaagggatgactagttcacattgggtggtcaaggaaggcctctcagagagaggctgttgggatctaagtataaagcaggtgaggcaaagaccataaggtgggaaggaacttggtttgtcctaagaacagagagaagactggcattgggcatagagcataccaaacaagagagaatgtggtcccaggtgagcctggagagaccgggcccagattgtgaagggctttgtaggctggtgtaggaagtgtggatttaagtgtaagtgtgatgagtttgaggcactttaggatcaagctgttgggagtcttgaaggaaaggaatgacatggcctgatttctgtttttaaaagtcatcctgattggtgaatgaagaatagattcagaggaggagctgggaaggggacaataaccatatccttacccagtaagcatgagatggataacatgaatctgcttttcctgttccctagtttgtcccagttcctgttattttatggtgagagcatgtcaccacacttaagagcagtataaggggactggatgtggtggttcatgcctgtaatcccagcactttgggaggttgaggcagctggatcacctgaggtcaggagttggagaccagcctggccaacatggcaaaacctcatatctactaaaaatacaaaaattagtcaggcgtggtggcaggcgtctgtaatcccagctactcgggaggctgaggcaggagaattgcttgagcctgggaggcagagattgcagtgagccgagatcatgccactgcactccagccttagcaacagagcgagacggttaccttggcaaccgtctcaaaaaaaaaagaaacaaaaaaaagcagtgtaagggaaccagcgaactccaccaagtatagaatgataaataaatcatggtctgtttctacaattgaacactacacagccatgcaaacaagaatgcattacttctctacctaataatatgaattaatatggccataacattgggcaaaaaaagccagacacaaaagagtaaactactgcgtggttccctttatttgaagttcaaaatcaggaaaaactaatctatggtggcaaatattagaataatggttacctttggagaagagtattatctaggaggaggcatgaaggagcctgctggtgaattgaaaatgccctacatcttgatctgggtggtggttatggttacatggaggtaatacatgtttttaaaaaatcattaagttattaagatttctgcttctgatgcaagttacacctcaataaaaaggggaaaaaaaaacagtgcctatgcctacctccagaaaatgttgattcattggtctggagtagagcacaggcaggggtaattttttaacatcttccagatgcttccaatatgcagccagggtcgagaatgactcccttacatgattggactcccttacatgattggactcccttacatgattggactcccttacatgattggactcccttacatgattagacttaactgagttttggtcaagcagggcagtagctgtaagctttggaagagaaagccagcagttatccgagcggttccctcccatctgtgagactcttgctcatgtcagcagtattcccttgtcttcccctcggacaggtgatgggcctgagacgggtttgaaataggtcaggatagaaccttcatggactctagtgttctattgcacattaagcctcaaattaacttttcattctggtttccaaccactctgtccttacaggtcatgaaaggaacaccaatgttttgcaaactatgggcagcagtgtttttgagggtcatgatcagtttagtgtagcaattctctatcttttcttaagatcttaggacccctttattcttgtaaagagtgagagccccaaagaccttttgtgtatgtagatatatttaaaaattaaaatagaaaatttttaaatatttgtttataaataatacgttaccttttagatataaaattaactcatcacataatgagaaacaaaatttctgttacagaaacatttcacccaaatcattgtagtaatactaagctgattctaaaaggacaaatttaacataaacatattcatgagaaataactattttctaaaacaaaaaaattcagtgagacaagtagaattgttttacatttctccaagtctctttaatgtctggcttcatggaacacagccgtttctcatatctgcttgtgcattcagtctgtgacattagcgcctgtcacgaagcctctggaaagctccgctgcatagtcatgagagaacgaggatgaaaaagacaaaacatctcagcagtattaggaaaatagttttgacctcataggccccctgaaatatggtcttgggacccccggactttgagaaccactggttagtgggcctccactagtgtgtgtgtgatgaactagaatagaatatgtcagtgcattgcactcagtaagggtgaatattttgactgaacgtctgtttcaaccacttcagagcctctctgttcacctcttactccagccactgatgccccaaacagttcatgcaaatttaaccacatccacataggtgcctcttatagtacactctggaaggagaggggttaacacccacaggaccagcctggagcccaacctgggagaggtatcagtggatatacacatccttctttcagcccggaggagacagttctgcactgcattccatgagctcctcagaaggtctcatgggattgaactgcggttgccacgatggtggtggactcagcccacgtgcttgtctgtctgatgtgttttgcaccctctgccacttggccctgctctctgtggtcactttcccagtaaattgcctgcacacaagcctttgtcccagtctctgctttcagaactccagctgagatgttttttgtttttggtatttttgagacaggatcaaagctggaatgcagtggtgccatcatggctcactgcagccttgaactcccaggctcaagcgatcctcccacctcagcctcccaagtagctatgaccacaggcatgcaccgctatgcctagctaatctttttattttttttttttttgtagtgacagggtctccctgtgttgcccaggctgtgagatgtttttgttttgtaaaaattgtgcttctgccatgatgtataatgcatgtcctaatttaagaaaaaagtttgaaagacactgttctgcaatgagcccaaataatagcctaaaatactccaaatagaaagtgtcaataatataaaaatttccatatattaacaaaaccttctccagtgattcaactcccagggagaaataaaagcccaagtatgaaatcacctaatgaaaagccaacataatttaaatccaaaattctgctccccctaatttcttgacctgccctgttttagttaaaaggatctcaatcagatgtttgggtttcctcaggaagctgctgcctaggctgtcataagaatgggagtcattccttaagcacattgacccaacccaaaatttcttgcatctcccagttttttaaagattcagtaggctatatgaaaatgtcatattaacagtcccatgcccatggaactttgaaaatccaaataaatcaactcctacagcaatagtgatggaacccagtacattgtatagtacagacccaccagccagtaactagaacagacttgatgggacatggggaaaggaagacagaaaacggaagaggaaagagagattcttcttgattcatcgtgctggggtgcaggtcaggctatggcagttttcatgggtctcagtcactcagtttaacacaattaggttcatggtggcactatttactattttgggttgggaggaaatgtacttatcccaccttttctagtcaggagagtttgtcattccatggtaaaataaataaataaataataatcctaaattgtcaatggcttaacataacagtttagttttcaaagaactgcactttgaggtagccaccaaatctgaacagggccacatggacaagcacagtggatgtttcagtgattacctatctggacctatgactgaggaccagatattcttttcctctctgtgcctcatcaccacttaagtctcagaggtcagaaatgcaatggaaatctcaattagggaccaaaggactcacagagtgagaaatgatggcattgtggaaaatacagtcttgaacaagggcatttgtggaccaagatttatattttcacacaatgcaggggaagttaatgtccaataattcaatacctgcctaaggttatttctgcaaatccagcatgcccaagctctgcttgtataggttacagtcacaggggaccctatggccagggctggaagaagccagctagagcctcacagtgactcagatgccacactccaattgcactgtagtcagcccacttgtgtcataaagcctgtttacacaaagcctagcatattagaagcagctgtgagtcagcctgcttcagctgctgctgctgccccaagaggcccatctctccctgtgatactttggtttctaaggcaacctcttttgaatgttctcagtgaatgcaccatgggtgggcacatcctggggaaagttcagtcactcactcctcaccaccattctgtgaaggacttacgcacctggcaagaattaaaatgcagtgtctaccttattgctgatggagcccgattttcaagtgctgcataagcctgaagccaaaatcatgctttcttccctaaatctagacttggggactgatgtgaggaggactgggcctgcagacctggagacatggcctgaccagctgcatgctcaggaggtggcagggccaggtggatagcagacaactccatgcagtcactcttggctcgttttcacccatcggctaagtcacagctcttcccaggggtataaagaatatggggggttgggcgcggtggctcacacctgtaatctcagcaatttgggaggctgaggcaggtggatcacctgaggtcggaagtttgagaccagcctgaccaacatggagaaaccctgtctctactaaaaacacaaaattagccgggcgtggaggtgggcgcctataatcccagctactcaggaggctgaggcaggacaatcgcttgaacccgggaggtggaggttgcagtgagccgagattgctccattgcactccagcctgggcaacaagagtgaaactccatctcaaaaaataaaaaagaatatagggaagacagagtggcagaagtggcttcctcactactaccccaaaaagactgaagtgttgcaattgttgaggcaaaaacatgatggctcccagacactagccacttgggctgtctcctgttttcccctattttaaacaatgagtacaacaaacatcttttgtggataaactttatgaaattgtgtccttgggctaggcttcttgtattggaattactacagggtcaaagagcttgaatgttgatatggttcagctctgtgtccccacccaaatctcatctcgaattttaatccccacgtgttgagggagggacctggtgggaggtgactggatcatgggagtggtttccccaaagctgttctcctgaaagtgagggaggcctcacgagatctgatgatttaaaagtggcagtttcccctgcattctatctctgtctctccttccactatgtaagacacgccttgcttccccttcaccttctgccgtgaatgtaagtttcctgaggcctccccagccatgtggaactgtgagtcaattaaacctcttgtttataaat

SEQ ID NO: 165085 - DNA, 972 bp, Homo sapiens
  Payload ID: 12509
  Gene Symbol: PIGP
  Gene Name: phosphatidylinositol glycan anchor biosynthesis, class P
  Uniprot ID: P57054
  ENST ID: ENST00000399098
  CDS Start-End: 438-764
gagccgcgggatcacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcaaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatggtactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccata

SEQ ID NO: 165086 - DNA, 688 bp, Homo sapiens
  Payload ID: 12509
  Gene Symbol: PIGP
  Gene Name: phosphatidylinositol glycan anchor biosynthesis, class P
  Uniprot ID: P57054
  ENST ID: ENST00000399102
  CDS Start-End: 76-480
gaatgggcagggcccggggcctgggcgccgcgacctagtaggcccgcatgctgattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccata

SEQ ID NO: 165087 - DNA, 656 bp, Homo sapiens
  Payload ID: 12509
  Gene Symbol: PIGP
  Gene Name: phosphatidylinositol glycan anchor biosynthesis, class P
  Uniprot ID: P57054
  ENST ID: ENST00000399103
  CDS Start-End: 44-448
ctcagcgctgaggtggccgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccata

SEQ ID NO: 165088 - DNA, 803 bp, Homo sapiens
  Payload ID: 12509
  Gene Symbol: PIGP
  Gene Name: phosphatidylinositol glycan anchor biosynthesis, class P
  ENST ID: ENST00000430792
  CDS Start-End: 727-803
ggccgaggtgtcgggaggggcctgggtgggcgtatgaaggacccgaggtcgagggcccccccataccccgcctcgaatgagaaatagaagtctccacgaatgggcagggcccggggcctgggcgccgcgacctagtaggcccgcatgctggtgggcgccgcgcgagccttgttccctgccctcccctcccacagggaggccacgcttgcagagctggagcgcgcgtctatcgccccagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcaatggtgccacggagcacatcgctgacgctgattgtgttccttttccacagattgtctaaagccccaggaaaaatggtggaaaattcaccgtcgccattgccagaaagagcgatttatggctttgttcttttcttaagctcccaatttggcttcaaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatggtactttacctcgtgtgggcctttattcctgaatcttggctaaactctttaggtttaacctattggcctcaaaa

SEQ ID NO: 165089 - DNA, 3437 bp, Homo sapiens
  Payload ID: 12509
  Gene Symbol: PIGP
  Gene Name: phosphatidylinositol glycan anchor biosynthesis, class P
  ENST ID: ENST00000464265
  CDS Start-End: 225-701
tcccacagggaggccacgcttgcagagctggagcgcgcgtctatcgccccagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcaatggtgccacggagcacatcgctgacgctgattgtgttccttttccacagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccatatagcagacttaaaaaaaaaaatcaatgtcagtataatcaagaagttcctccagagaggcatttatattgtaatttgcaaagggcaatgatgtccttcctcctgtttgtcctgaggggcccagaattcaaacccttagtttttgggaagggtacagttagtacttgtgccatcagattcatgtctaagacacaaatatttgttgagtactcactgtgtaccaggtatttttctaggcactgaggatgaagtaatggtaagattctctctcaaagagcttatagttttagaagcagggtgaggcaactaagcaaataaacaaggaaatataatttgatgagtgctatgcaaagaattaagataatgtattctagaatgcaaagggatgactagttcacattgggtggtcaaggaaggcctctcagagagaggctgttgggatctaagtataaagcaggtgaggcaaagaccataaggtgggaaggaacttggtttgtcctaagaacagagagaagactggcattgggcatagagcataccaaacaagagagaatgtggtcccaggtgagcctggagagaccgggcccagattgtgaagggctttgtaggctggtgtaggaagtgtggatttaagtgtaagtgtgatgagtttgaggcactttaggatcaagctgttgggagtcttgaaggaaaggaatgacatggcctgatttctgtttttaaaagtcatcctgattggtgaatgaagaatagattcagaggaggagctgggaaggggacaataaccatatccttacccagtaagcatgagatggataacatgaatctgcttttcctgttccctagtttgtcccagttcctgttattttatggtgagagcatgtcaccacacttaagagcagtataaggggactggatgtggtggttcatgcctgtaatcccagcactttgggaggttgaggcagctggatcacctgaggtcaggagttggagaccagcctggccaacatggcaaaacctcatatctactaaaaatacaaaaattagtcaggcgtggtggcaggcgtctgtaatcccagctactcgggaggctgaggcaggagaattgcttgagcctgggaggcagagattgcagtgagccgagatcatgccactgcactccagccttagcaacagagcgagacggttaccttggcaaccgtctcaaaaaaaaaagaaacaaaaaaaagcagtgtaagggaaccagcgaactccaccaagtatagaatgataaataaatcatggtctgtttctacaattgaacactacacagccatgcaaacaagaatgcattacttctctacctaataatatgaattaatatggccataacattgggcaaaaaaagccagacacaaaagagtaaactactgcgtggttccctttatttgaagttcaaaatcaggaaaaactaatctatggtggcaaatattagaataatggttacctttggagaagagtattatctaggaggaggcatgaaggagcctgctggtgaattgaaaatgccctacatcttgatctgggtggtggttatggttacatggaggtaatacatgtttttaaaaaatcattaagttattaagatttctgcttctgatgcaagttacacctcaataaaaaggggaaaaaaaaacagtgcctatgcctacctccagaaaatgttgattcattggtctggagtagagcacaggcaggggtaattttttaacatcttccagatgcttccaatatgcagccagggtcgagaatgactcccttacatgattggactcccttacatgattggactcccttacatgattggactcccttacatgattggactcccttacatgattagacttaactgagttttggtcaagcagggcagtagctgtaagctttggaagagaaagccagcagttatccgagcggttccctcccatctgtgagactcttgctcatgtcagcagtattcccttgtcttcccctcggacaggtgatgggcctgagacgggtttgaaataggtcaggatagaaccttcatggactctagtgttctattgcacattaagcctcaaattaacttttcattctggtttccaaccactctgtccttacaggtcatgaaaggaacaccaatgttttgcaaactatgggcagcagtgtttttgagggtcatgatcagtttagtgtagcaattctctatcttttcttaagatcttaggacccctttattcttgtaaagagtgagagccccaaagaccttttgtgtatgtagatatatttaaaaattaaaatagaaaatttttaaatatttgtttataaataatacgttaccttttagatataaaattaactcatcacataatgagaaacaaaatttctgttacagaaacatttcacccaaatcattgtagtaatactaagctgattctaaaaggacaaatttaacataaacatattcatgagaaataactattttctaaaacaaaaaaattcagtgaga

SEQ ID NO: 165090 - DNA, 2846 bp, Homo sapiens
  Payload ID: 12510
  Gene Symbol: PIGQ
  Gene Name: phosphatidylinositol glycan anchor biosynthesis, class Q
  Uniprot ID: Q9BRB3
  ENST ID: ENST00000026218
  CDS Start-End: 89-2371
gtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgga

SEQ ID NO: 165091 - DNA, 603 bp, Homo sapiens
  Payload ID: 12510
  Gene Symbol: PIGQ
  Gene Name: phosphatidylinositol glycan anchor biosynthesis, class Q
  ENST ID: ENST00000293874
  CDS Start-End: 159-603
cacttcctccagttctagtttccaacaacagaggctgcagccacccagccccgaagcagggcccagcgagacagggcccagccccaagcgtgacccagctgcagagaagctgagacggtgattcggactgactggactctggcctccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccg

SEQ ID NO: 165092 - DNA, 3006 bp, Homo sapiens
  Payload ID: 12510
  Gene Symbol: PIGQ
  Gene Name: phosphatidylinositol glycan anchor biosynthesis, class Q
  Uniprot ID: Q9BRB3
  ENST ID: ENST00000321878
  CDS Start-End: 160-1905
gcggcaacgcgcggagccggcggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggagcgcaggctcggtcccgggtccatgtg

SEQ ID NO: 165093 - DNA, 1915 bp, Homo sapiens
  Payload ID: 12510
  Gene Symbol: PIGQ
  Gene Name: phosphatidylinositol glycan anchor biosynthesis, class Q
  Uniprot ID: Q9BRB3
  ENST ID: ENST00000409527
  CDS Start-End: 170-1915
ctagtttccaacaacagaggctgcagccacccagccccgaagcagggcccagcgagacagggcccagtggggccttattctctctcttgcagccccaagcgtgacccagctgcagagaagctgagacggtgattcggactgactggactctggcctccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactga

SEQ ID NO: 165094 - DNA, 586 bp, Homo sapiens
  Payload ID: 12510
  Gene Symbol: PIGQ
  Gene Name: phosphatidylinositol glycan anchor biosynthesis, class Q
  ENST ID: ENST00000439574
  CDS Start-End: 252-586
ggaagtggggctcgggtcccgcggcggggctggaggcagcgagcgccgtcgtctgcccgggcccgcccatcggggtccccaaccccatccggaccccgccgcccgagcgcgcggccccggaagcacccgtagagacttggtttcacccccatcgaggctggtcttaagctcctgacctcaagtgatccgcccgcctcggcctcccaaagtgctgggattacaggcgtgagccaccgcgccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccg

SEQ ID NO: 165095 - DNA, 932 bp, Homo sapiens
  Payload ID: 12510
  Gene Symbol: PIGQ
  Gene Name: phosphatidylinositol glycan anchor biosynthesis, class Q
  ENST ID: ENST00000420990
  CDS Start-End: 1-715
gctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcgggttcagaaccctggagacctgaggccacaggcctttgttcttctgccttgggattttctgggcttgggagtctgaactgcaggccaggggccaagcgcggcaaagtcagaggcactaggagccagcagggcggccaccatccactggcgtgaagttccgtgtcctccggcacgaggccggcaggcccctccgcctcctgatgcagggcctgaggacactggtgtggtcctgtggatggggcccattctgccctgtgtcggaggcgcccttggctggctggggctgccctgggccccacagggctcaagttctgggtggaacagaaccgactgagtgagtcctggggtggggtgtgcgtccctgtggcac

SEQ ID NO: 165096 - DNA, 2054 bp, Homo sapiens
  Payload ID: 12510
  Gene Symbol: PIGQ
  Gene Name: phosphatidylinositol glycan anchor biosynthesis, class Q
  ENST ID: ENST00000443147
  CDS Start-End: 64-1788
agaggacttacaggtcacaccaccccgacgtgtgcatcctgctctgttccctcgtccctaaggatgtggtgggctctgagacctccaggcatcctgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcgggttcagaaccctggagacctgaggccacaggcctttgttcttctgccttgggattttctgggcttgggagtctgaactgcaggccaggggccaagcgcggcaaagtcagaggcactaggagccagcagggcggccaccatccactggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccag

SEQ ID NO: 165097 - DNA, 2052 bp, Homo sapiens
  Payload ID: 12510
  Gene Symbol: PIGQ
  Gene Name: phosphatidylinositol glycan anchor biosynthesis, class Q
  ENST ID: ENST00000422307
  CDS Start-End: 131-1321
ggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccacaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaatgaaagtctcttcctgc

SEQ ID NO: 165098 - DNA, 608 bp, Homo sapiens
  Payload ID: 12510
  Gene Symbol: PIGQ
  Gene Name: phosphatidylinositol glycan anchor biosynthesis, class Q
  ENST ID: ENST00000540241
  CDS Start-End: 1-420
ggcctgtcctcactgtggcgtctgttccgggggaagaagtggaacgttctgcgccagcgcgtggactcctgttcctatgacctggaccagctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtgg

SEQ ID NO: 165099 - DNA, 2112 bp, Homo sapiens
  Payload ID: 12510
  Gene Symbol: PIGQ
  Gene Name: phosphatidylinositol glycan anchor biosynthesis, class Q
  Uniprot ID: Q9BRB3
  ENST ID: ENST00000470411
  CDS Start-End: 45-944
cccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggtgtgggcctgccctggtctctgcagggctgggtgcgtgccctctggccccttctccatccccctctgcaccacgctgacccctccggccaggcaggcctcctcctgcggccccaggctgtgctggccaccctcatgccggccgggccggacctcccttccaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccacaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaa

SEQ ID NO: 165100 - DNA, 936 bp, Homo sapiens
  Payload ID: 12510
  Gene Symbol: PIGQ
  Gene Name: phosphatidylinositol glycan anchor biosynthesis, class Q
  ENST ID: ENST00000635205
  CDS Start-End: 1-310
cgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagg

SEQ ID NO: 165101 - DNA, 2397 bp, Homo sapiens
  Payload ID: 12511
  Gene Symbol: PIGS
  Gene Name: phosphatidylinositol glycan anchor biosynthesis, class S
  ENST ID: ENST00000268758
  CDS Start-End: 33-158
ccccacggtggccggagcagccggaagctagcatggcggccgccggggctgcggctacacacctagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgatacaaa

SEQ ID NO: 165102 - DNA, 2877 bp, Homo sapiens
  Payload ID: 12511
  Gene Symbol: PIGS
  Gene Name: phosphatidylinositol glycan anchor biosynthesis, class S
  Uniprot ID: Q96S52
  ENST ID: ENST00000308360
  CDS Start-End: 377-2044
tccattttcagatgagcctcggagctgcctgtagttgcccagctagtatttaaggactgcagaggttgcgctcttgattgcggggctagaagtgtgttctacagggaagcggggaacttcgttccagcagcgccgaaacccgcacggcccctaggctgtccctccgcgcccgggtgacttcctttcagatccccagcgaagctcccagcggagccctcccacccctcgcccgcttgctcccgtctgcgggtctggagtagcgctcgcgattggccccgatcaccgccgcggtcctgccccctcgttgcagagattccgattgggtgaggctcacgaagctctgcccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 165103 - DNA, 2815 bp, Homo sapiens
  Payload ID: 12511
  Gene Symbol: PIGS
  Gene Name: phosphatidylinositol glycan anchor biosynthesis, class S
  Uniprot ID: Q96S52
  ENST ID: ENST00000395346
  CDS Start-End: 339-1982
agctctgcccccacggtggccggagcagccggaagctagcatggcggccgccggggctgcggctacacacctaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccgggtcccttcgcacggagatcccaatgaacgcgggcccctggaggccggtggttggggcttctccgcgtcggggatggggccggtaccctagcccgtttccagcgcctcagtcggttccccatgccctcagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 165104 - DNA, 584 bp, Homo sapiens
  Payload ID: 12511
  Gene Symbol: PIGS
  Gene Name: phosphatidylinositol glycan anchor biosynthesis, class S
  ENST ID: ENST00000584080
  CDS Start-End: 45-170
acgaagctctgcccccacggtggccggagcagccggaagctagcatggcggccgccggggctgcggctacacacctagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggac

SEQ ID NO: 165105 - DNA, 594 bp, Homo sapiens
  Payload ID: 12511
  Gene Symbol: PIGS
  Gene Name: phosphatidylinositol glycan anchor biosynthesis, class S
  ENST ID: ENST00000582721
  CDS Start-End: 43-393
gaagctctgcccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcaggtgagactgctgtgcgggagggtcgggggacagcccccccggcaaggtggagactcagtgacggccctgatgctccttcctgtagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttcccca

SEQ ID NO: 165106 - DNA, 1694 bp, Homo sapiens
  Payload ID: 12512
  Gene Symbol: PIGT
  Gene Name: phosphatidylinositol glycan anchor biosynthesis, class T
  Uniprot ID: Q969N2
  ENST ID: ENST00000279035
  CDS Start-End: 48-1478
ttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagt

SEQ ID NO: 165107 - DNA, 2235 bp, Homo sapiens
  Payload ID: 12512
  Gene Symbol: PIGT
  Gene Name: phosphatidylinositol glycan anchor biosynthesis, class T
  Uniprot ID: Q969N2
  ENST ID: ENST00000279036
  CDS Start-End: 81-1817
acttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggtt

SEQ ID NO: 165108 - DNA, 1971 bp, Homo sapiens
  Payload ID: 12512
  Gene Symbol: PIGT
  Gene Name: phosphatidylinositol glycan anchor biosynthesis, class T
  Uniprot ID: Q969N2
  ENST ID: ENST00000372689
  CDS Start-End: 21-1556
aggcggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtg

SEQ ID NO: 165109 - DNA, 1807 bp, Homo sapiens
  Payload ID: 12512
  Gene Symbol: PIGT
  Gene Name: phosphatidylinositol glycan anchor biosynthesis, class T
  ENST ID: ENST00000455050
  CDS Start-End: 17-388
ggaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgaacactgaccactactttctgcgctatgctgtgctgccgcgggaggtggtctgcaccgaaaacctcaccccctggaagaagctcttgccctgtagttccaagggcttctcttatctctttccatctcctccaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacagg

SEQ ID NO: 165110 - DNA, 326 bp, Homo sapiens
  Payload ID: 12512
  Gene Symbol: PIGT
  Gene Name: phosphatidylinositol glycan anchor biosynthesis, class T
  ENST ID: ENST00000432270
  CDS Start-End: 1-326
gctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactc

SEQ ID NO: 165111 - DNA, 2000 bp, Homo sapiens
  Payload ID: 12512
  Gene Symbol: PIGT
  Gene Name: phosphatidylinositol glycan anchor biosynthesis, class T
  Uniprot ID: Q969N2
  ENST ID: ENST00000543458
  CDS Start-End: 14-1582
agtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggtt

SEQ ID NO: 165112 - DNA, 675 bp, Homo sapiens
  Payload ID: 12512
  Gene Symbol: PIGT
  Gene Name: phosphatidylinositol glycan anchor biosynthesis, class T
  ENST ID: ENST00000545755
  CDS Start-End: 1-517
catgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgtaagtgtgaccacactcactgataacacatcctcagctgcctgctgggccttaacacaggtgaccaggctcctgcaggggagttcagggtagatgttacatcttccaaagagatgtgtagatttaattcaatcctaataaaaatcctggcagtctgtggaa

SEQ ID NO: 165113 - DNA, 1632 bp, Homo sapiens
  Payload ID: 12513
  Gene Symbol: PIGU
  Gene Name: phosphatidylinositol glycan anchor biosynthesis, class U
  Uniprot ID: Q9H490
  ENST ID: ENST00000217446
  CDS Start-End: 1-1308
atggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtcta

SEQ ID NO: 165114 - DNA, 1248 bp, Homo sapiens
  Payload ID: 12513
  Gene Symbol: PIGU
  Gene Name: phosphatidylinositol glycan anchor biosynthesis, class U
  Uniprot ID: Q9H490
  ENST ID: ENST00000374820
  CDS Start-End: 1-1248
atggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtag

SEQ ID NO: 165115 - DNA, 509 bp, Homo sapiens
  Payload ID: 12513
  Gene Symbol: PIGU
  Gene Name: phosphatidylinositol glycan anchor biosynthesis, class U
  ENST ID: ENST00000438215
  CDS Start-End: 1-509
gtctctgtacccactcaccttgtttgtcccaggactcctctatctcctccagcggcagtacatacctgtgaaaatgaagagcaaagccttctggatcttttcttgggagtatgccatgatatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgc

SEQ ID NO: 165116 - DNA, 2367 bp, Homo sapiens
  Payload ID: 12514
  Gene Symbol: PIGV
  Gene Name: phosphatidylinositol glycan anchor biosynthesis, class V
  Uniprot ID: Q9NUD9
  ENST ID: ENST00000078527
  CDS Start-End: 332-1813
gtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctgggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgtttttttttatgatttgtgcatgtatttttatatgaaaaaaacttacaaagatatgcaaattaaacttctttcagttataca

SEQ ID NO: 165117 - DNA, 2713 bp, Homo sapiens
  Payload ID: 12514
  Gene Symbol: PIGV
  Gene Name: phosphatidylinositol glycan anchor biosynthesis, class V
  Uniprot ID: Q9NUD9
  ENST ID: ENST00000374145
  CDS Start-End: 683-2164
gcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctgggtcagagcgacttctccagcctgcgcagggggtgttagtcttacccagagggtccagagctgccgttcaacaggatgtcccagattctcagatagggcccaactaccctaagcatacctagcaagggcaggctgcggcatggaagtactgggctaggcgtttgggtgacctgggtcataatcctggctcggaaagggcgcgtaccctttggcgagggatgcgggctggtaccgtgaggtttaagaagcagaaaacatgacagcctctttaagtagccctgggtacgtcacttgaccccagtgagcctcagtttccatatccataaaatggcgatggtaattatactagcctcacagtgtctgatgagatctctggagcctatttatctcacgggaaaatttttgaagagtgaaactagttgatctaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgtttttttttatgatttgtgcatgtatttttatatgaaaaaaacttacaaagatatgcaaattaaacttctttcagtt

SEQ ID NO: 165118 - DNA, 716 bp, Homo sapiens
  Payload ID: 12514
  Gene Symbol: PIGV
  Gene Name: phosphatidylinositol glycan anchor biosynthesis, class V
  ENST ID: ENST00000431541
  CDS Start-End: 355-716
gaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatc

SEQ ID NO: 165119 - DNA, 608 bp, Homo sapiens
  Payload ID: 12514
  Gene Symbol: PIGV
  Gene Name: phosphatidylinositol glycan anchor biosynthesis, class V
  ENST ID: ENST00000430292
  CDS Start-End: 393-608
acacccaggacgcagggtgccgctgccggccacagaaaccccaagaatgtttttctttggctattcagaggacatctattgtgtgtcaggccctgtgctgagctgttgttgcctgacagcaggaagagcgcggctctggtttctgtgaagaggctgcgggtcagcctccgactacaagagcctcggcccacaccgggaactcagtgaacgtcagcgggagctggggcaagagcactgactctgagacagcagcctccgctcactatttgaaggcggggtggcggggggccttgaaggagagcgaagtgcgagagaactcttcaggtgtcaccaagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttg

SEQ ID NO: 165120 - DNA, 707 bp, Homo sapiens
  Payload ID: 12514
  Gene Symbol: PIGV
  Gene Name: phosphatidylinositol glycan anchor biosynthesis, class V
  ENST ID: ENST00000455364
  CDS Start-End: 161-707
ttacctgtaagcaaagtgtgggctacacacatctgtagtcgctgaggctagagcttgactcgagagaggaaaggaagaatgcaagcatggtcaagtggcagagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggc

SEQ ID NO: 165121 - DNA, 932 bp, Homo sapiens
  Payload ID: 12514
  Gene Symbol: PIGV
  Gene Name: phosphatidylinositol glycan anchor biosynthesis, class V
  ENST ID: ENST00000472757
  CDS Start-End: 84-308
cgtgggccccggatggaggagctgagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctggg

SEQ ID NO: 165122 - DNA, 2264 bp, Homo sapiens
  Payload ID: 12515
  Gene Symbol: PIGW
  Gene Name: phosphatidylinositol glycan anchor biosynthesis, class W
  Uniprot ID: Q7Z7B1
  ENST ID: ENST00000620233
  CDS Start-End: 56-1570
acgtagaccgtctgctgggggcgccggcaccatttggagtacgtgaggaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatgggacaggagcaatggattttggagtaggtggctttgtttttgggtctgcaatggtttgtctagaggtcaggaggagaaaatatatggaagggtccaaattgcattactttacaaactcattgtactctgtttggccattagtcttcctaggaatcggacgattagccattataaaatcaataggctatcaggaacatttaacagagtatggagttcactggaactttttctttaccataatagttgtgaaattgataacaccactgctgttgattatttttcccctaaataagtcctggattattgccctcggcattactgtattataccagctagcccttgactttacctcactgaagaggttaatattatatggcactgatggtagtggcacacgggttggtctattaaatgccaaccgcgaaggaataatctctaccctggggtatgtggcaatacacatggctggtgtgcaaacagggttatatatgcataagaaccgatcacatatcaaagacttgataaaagtagcctgttttcttttactggcagctattagcctcttcatatctctttacgtagttcaagtaaatgtagaagcagtatctcgaagaatggcaaatttagccttttgtatttggatagttgcttctagcctgatccttcttagtagtttattactgggtgatataattttgagttttgccaaatttctaattaaaggagctctagtaccatgttcttggaaacttatccagtcacctgttacaaataaaaagcattcagaatctctagtccctgaagccgaaagaatggaacccagtctttgtttaatcacagctctaaacagaaaacagttaatatttttcttgctgtcaaatataacaactggcctgatcaacctgatggtagatacattacacagcagtaccttgtgggccttatttgtggtcaatctctatatgttttccaactgtttaattgtatatgtactatatttgcaagataagactgtacaattttggtgatcagcaggagtaggatatataagtatttgggcaatatttaatgaggaatattaattgtaaagaaattgtgcttttggcaacagtgttaaccatattttattataaaatagtttcagtcatctaaacagcagtgatgcttaattatttttttttttgagacagagtcttgctctgttacccaggctggagtgtagtggtgccatctcagctcactgcaacctccacctcccgggttcaagcaattctcctgcctcagcctcctgagtagctggcactgtaggcatgtaccaccatgcccagctaatttttatatttttagtagagatggggttttgccatattggccaggctggtctcaaactcctgaactcaagtgataacacccaccttggcctcccaaagtgctgggattacaggtgtgagccaccacactgggccaatgcttaatattttaatgtatctcaacaataaaaccaagaagaaacaaagccttttgacttgttagaatgtattaagtagtattttaaagaaactttatagttgtgacattgaaagactgttggggtggggggaggaaaatttttactttccatcttaatgtaaccttatgctattctgtatttttactgtatattgcttttacaataaatataaaatgaaatgtttatgttgacatttcagtgtgaactgtgga

SEQ ID NO: 165123 - DNA, 876 bp, Homo sapiens
  Payload ID: 12515
  Gene Symbol: PIGW
  Gene Name: phosphatidylinositol glycan anchor biosynthesis, class W
  ENST ID: ENST00000619326
  CDS Start-End: 44-876
gggacgcctggtccggcttgctggcttcaactacggaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatgggacaggagcaatggattttggagtaggtggctttgtttttgggtctgcaatggtttgtctagaggtcaggaggagaaaatatatggaagggtccaaattgcattactttacaaactcattgtactctgtttggccattagtcttcctaggaatcggacgattagccattataaaatcaataggctatcaggaacatttaacagagtatggagttcactggaactttttctttaccataatagttgtgaaattgataacaccactgctgttgattatttttcccctaaataagtcctggattattgccctcggcattactgtattataccagctagcccttgactt

SEQ ID NO: 165124 - DNA, 2264 bp, Homo sapiens; identical to SEQ ID NO: 165122
  Payload ID: 12515
  Gene Symbol: PIGW
  Gene Name: phosphatidylinositol glycan anchor biosynthesis, class W
  Uniprot ID: Q7Z7B1
  ENST ID: ENST00000616581
  CDS Start-End: 56-1570

SEQ ID NO: 165125 - DNA, 2312 bp, Homo sapiens
  Payload ID: 12515
  Gene Symbol: PIGW
  Gene Name: phosphatidylinositol glycan anchor biosynthesis, class W
  Uniprot ID: Q7Z7B1
  ENST ID: ENST00000614443
  CDS Start-End: 560-2074
ggcttcaactacggtgagatgttttgcgaccctggggtaaaatgagggtaaagcggcagcttcccacgttctgggggagaagcgcggaagcacggtttcctgggccttcgggcgacaccaggactgggggtctttcagtagaggtcgccgcggcggagtcttgtgcgagtgcggcggagtgttgtgcgaggccggcggacaccattaccctgatagggcctcgccgtgaggtctgaggggccgtgtgaggtgcatggcgcgccgtttcctctccaggcgctcctctcagggctacggccctagaagatctggcctgcaccagcccaaaggacatgacaggagtgggtagcccacgggacactggcacgagcgccatgatgggcggagacgcgcggaatcggccggcccggaagtgccagctgcctgcgtcggccggaagtgccgcgcgggaggcggaagcggctggttcccgcgtggtttggcgggtgcagcggcagtccggctgcccttcccacgtagaccgtctgctgggggcgccggcaccatttggagaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatgggacaggagcaatggattttggagtaggtggctttgtttttgggtctgcaatggtttgtctagaggtcaggaggagaaaatatatggaagggtccaaattgcattactttacaaactcattgtactctgtttggccattagtcttcctaggaatcggacgattagccattataaaatcaataggctatcaggaacatttaacagagtatggagttcactggaactttttctttaccataatagttgtgaaattgataacaccactgctgttgattatttttcccctaaataagtcctggattattgccctcggcattactgtattataccagctagcccttgactttacctcactgaagaggttaatattatatggcactgatggtagtggcacacgggttggtctattaaatgccaaccgcgaaggaataatctctaccctggggtatgtggcaatacacatggctggtgtgcaaacagggttatatatgcataagaaccgatcacatatcaaagacttgataaaagtagcctgttttcttttactggcagctattagcctcttcatatctctttacgtagttcaagtaaatgtagaagcagtatctcgaagaatggcaaatttagccttttgtatttggatagttgcttctagcctgatccttcttagtagtttattactgggtgatataattttgagttttgccaaatttctaattaaaggagctctagtaccatgttcttggaaacttatccagtcacctgttacaaataaaaagcattcagaatctctagtccctgaagccgaaagaatggaacccagtctttgtttaatcacagctctaaacagaaaacagttaatatttttcttgctgtcaaatataacaactggcctgatcaacctgatggtagatacattacacagcagtaccttgtgggccttatttgtggtcaatctctatatgttttccaactgtttaattgtatatgtactatatttgcaagataagactgtacaattttggtgatcagcaggagtaggatatataagtatttgggcaatatttaatgaggaatattaattgtaaagaaattgtgcttttggcaacagtgttaaccatattttattataaaatagtttcagtcatctaaacagcagtgatgcttaattatttttttttttgagacagagtcttgctctgttacccaggctggagtgtagtggtgccatctcagctcactgcaacctccacctcccgggttcaa

SEQ ID NO: 165126 - DNA, 2312 bp, Homo sapiens; identical to SEQ ID NO: 165125
  Payload ID: 12515
  Gene Symbol: PIGW
  Gene Name: phosphatidylinositol glycan anchor biosynthesis, class W
  Uniprot ID: Q7Z7B1
  ENST ID: ENST00000631508
  CDS Start-End: 560-2074

SEQ ID NO: 165127 - DNA, 876 bp, Homo sapiens; identical to SEQ ID NO: 165123
  Payload ID: 12515
  Gene Symbol: PIGW
  Gene Name: phosphatidylinositol glycan anchor biosynthesis, class W
  ENST ID: ENST00000632789
  CDS Start-End: 44-876

SEQ ID NO: 165128 - DNA, 953 bp, Homo sapiens
  Payload ID: 12516
  Gene Symbol: PIGX
  Gene Name: phosphatidylinositol glycan anchor biosynthesis, class X
  ENST ID: ENST00000296333
  CDS Start-End: 123-953
agcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataa

SEQ ID NO: 165129 - DNA, 3057 bp, Homo sapiens
  Payload ID: 12516
  Gene Symbol: PIGX
  Gene Name: phosphatidylinositol glycan anchor biosynthesis, class X
  Uniprot ID: Q8TBF5
  ENST ID: ENST00000392391
  CDS Start-End: 176-952
gggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaaaa

SEQ ID NO: 165130 - DNA, 838 bp, Homo sapiens
  Payload ID: 12516
  Gene Symbol: PIGX
  Gene Name: phosphatidylinositol glycan anchor biosynthesis, class X
  ENST ID: ENST00000451319
  CDS Start-End: 456-838
agcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataaccc

SEQ ID NO: 165131 - DNA, 1068 bp, Homo sapiens
  Payload ID: 12516
  Gene Symbol: PIGX
  Gene Name: phosphatidylinositol glycan anchor biosynthesis, class X
  ENST ID: ENST00000453218
  CDS Start-End: 1-192
gcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacaggaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctggagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgg

SEQ ID NO: 165132 - DNA, 523 bp, Homo sapiens
  Payload ID: 12516
  Gene Symbol: PIGX
  Gene Name: phosphatidylinositol glycan anchor biosynthesis, class X
  ENST ID: ENST00000457284
  CDS Start-End: 1-336
gcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcct

SEQ ID NO: 165133 - DNA, 744 bp, Homo sapiens
  Payload ID: 12516
  Gene Symbol: PIGX
  Gene Name: phosphatidylinositol glycan anchor biosynthesis, class X
  ENST ID: ENST00000426755
  CDS Start-End: 234-744
acagcaaggaggtagcccagccccgcgttcggctgctctcgaggaggccggagcccccggagacgatgcgccccgcgcagccgcctgcgcctgcgggagccggctgcccttgagatggagttgctgcctctttggctctgcctgggttttcacttcctgaccgtgggctggaggaacagaagcggaacagccacagcagcctcccaaggagtctgcaagttggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcag

SEQ ID NO: 165134 - DNA, 1677 bp, Homo sapiens
  Payload ID: 12516
  Gene Symbol: PIGX
  Gene Name: phosphatidylinositol glycan anchor biosynthesis, class X
  ENST ID: ENST00000415832
  CDS Start-End: 466-705
agagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaata

SEQ ID NO: 165135 - DNA, 677 bp, Homo sapiens
  Payload ID: 12516
  Gene Symbol: PIGX
  Gene Name: phosphatidylinositol glycan anchor biosynthesis, class X
  ENST ID: ENST00000421265
  CDS Start-End: 54-506
gcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaa

SEQ ID NO: 165136 - DNA, 217 bp, Homo sapiens
  Payload ID: 12517
  Gene Symbol: PIGY
  Gene Name: phosphatidylinositol glycan anchor biosynthesis, class Y
  Uniprot ID: Q3MUY2
  ENST ID: ENST00000527353
  CDS Start-End: 1-216
atgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgat

SEQ ID NO: 165137 - DNA, 675 bp, Homo sapiens
  Payload ID: 12518
  Gene Symbol: PIGZ
  Gene Name: phosphatidylinositol glycan anchor biosynthesis, class Z
  ENST ID: ENST00000443835
  CDS Start-End: 186-464
tccctcccggcccgccctgcgccggcggcggcggccccagtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccct

SEQ ID NO: 165138 - DNA, 1947 bp, Homo sapiens
  Payload ID: 12518
  Gene Symbol: PIGZ
  Gene Name: phosphatidylinositol glycan anchor biosynthesis, class Z
  ENST ID: ENST00000413127
  CDS Start-End: 1-148
cagggtgctttggggtggtctcagcctgctccgagtgctgtggtgtctccttccgcagacgggctatgtgcacccagatgagttcttccagtcccctgaggtgatggcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccctcacagcagcggtgtttgtggccacggacagctggtatttctccagccccgctacatccaggaaccttgtcctgacacctgtcaacttcttgcactacaacctgaatccccaaaacctggcgagacatggcacgcacgcgcggctcactcacctggcagtcaacggcttcctgctcttcggggtgctgcatgcccaggccctgcaggctgcgtggcaacggctgcaagtcggcctccaggcctctgcacaaatgggcctcctgagggcactgggtgcccggagcctgctgtccagccccaggtcctatctccttctcctctacttcatgcctctggccctgctatctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaagacaatgaactgctagtgacattcctcaatgacctctcccaaacctcccatgatgccttacccttgctgtcatgacaaccctctggcttcctaa

SEQ ID NO: 165139 - DNA, 2701 bp, Homo sapiens
  Payload ID: 12518
  Gene Symbol: PIGZ
  Gene Name: phosphatidylinositol glycan anchor biosynthesis, class Z
  Uniprot ID: Q86VD9
  ENST ID: ENST00000412723
  CDS Start-End: 148-1887
agtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcagaggacatcctgggcgttcaggccgcgcggccctgggagttttaccccagcagctcctgccgctcggtgctcttccccctgctgatctctggttccaccttctggctgctcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccctcacagcagcggtgtttgtggccacggacagctggtatttctccagccccgctacatccaggaaccttgtcctgacacctgtcaacttcttgcactacaacctgaatccccaaaacctggcgagacatggcacgcacgcgcggctcactcacctggcagtcaacggcttcctgctcttcggggtgctgcatgcccaggccctgcaggctgcgtggcaacggctgcaagtcggcctccaggcctctgcacaaatgggcctcctgagggcactgggtgcccggagcctgctgtccagccccaggtcctatctccttctcctctacttcatgcctctggccctgctatctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaagacaatgaactgctagtgacattcctcaatgacctctcccaaacctcccatgatgccttacccttgctgtcatgacaaccctctggcttcctaagacccatctgcctatcgaaatatgtgcaagtcagtgagacgaagtatagagaacaggtggcccagatccaggggacccaacttctggccccttggtctgtcacctcctcgctgtgtgatcttgagaaagctccttccactcacccaccccacttcccagtctgttgggatcagaggaactttgaggtgtctgccggctaacattgtgtcattcctggagtccacagtacacgtcccctgcctcaacaggcacagctctcacaaagctcttcaagcatggaagtgggagttgtgttgtacttcatggcactctgatgcctgctgtctcagtgtttggttattatgcaaacaagtaatgtttgaaatatataatagcactggagattttctcccta

SEQ ID NO: 165140 - DNA, 3912 bp, Homo sapiens
  Payload ID: 12519
  Gene Symbol: PITPNA
  Gene Name: phosphatidylinositol transfer protein, alpha
  Uniprot ID: Q00169
  ENST ID: ENST00000313486
  CDS Start-End: 257-1069
ttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaactttctggagtccagtttggtgatgtccattttccagctgtatgtatcctcaaacttgcactgataaccgccattttaccagggcaggattaggaagaggtacaaaggtgtgtctgaaaatttttgcacgtggatttctgcatataatagtcccgtgtcagtttacttatgcaaacattgcacatctgaattgtaattcggccgtttcctactgacaggatgtccttttgcttttgtctgcctcctcttcacatcttcctctttatccacc

SEQ ID NO: 165141 - DNA, 3612 bp, Homo sapiens
  Payload ID: 12519
  Gene Symbol: PITPNA
  Gene Name: phosphatidylinositol transfer protein, alpha
  ENST ID: ENST00000539476
  CDS Start-End: 232-1044
cgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttcttccaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagac

SEQ ID NO: 165142 - DNA, 573 bp, Homo sapiens
  Payload ID: 12519
  Gene Symbol: PITPNA
  Gene Name: phosphatidylinositol transfer protein, alpha
  ENST ID: ENST00000576010
  CDS Start-End: 325-573
ggaaccggagctccgggcggcgtcggcagcggcgcgagaggcgacgaggcccgggcggcaggagccggcgcggcgaccgcggcgagggcggcggggacggagcagagcacgacgaagacgcacagtcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggca

SEQ ID NO: 165143 - DNA, 504 bp, Homo sapiens
  Payload ID: 12519
  Gene Symbol: PITPNA
  Gene Name: phosphatidylinositol transfer protein, alpha
  ENST ID: ENST00000573231
  CDS Start-End: 373-504
ggagagcggccggcgggcagcgggcgggaggccgggcgggccgcgggcagccaccgagccgcgaagcgacatggtgctgctcaaggagtagggactgggggacaggtggagatgtttggtgtgctaaatctttcaagtacaagatgagccatcgttgaagctcagggttccaatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaacca

SEQ ID NO: 165144 - DNA, 793 bp, Homo sapiens
  Payload ID: 12519
  Gene Symbol: PITPNA
  Gene Name: phosphatidylinositol transfer protein, alpha
  ENST ID: ENST00000576722
  CDS Start-End: 368-793
cgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataag

SEQ ID NO: 165145 - DNA, 1264 bp, Homo sapiens
  Payload ID: 12519
  Gene Symbol: PITPNA
  Gene Name: phosphatidylinositol transfer protein, alpha
  ENST ID: ENST00000575288
  CDS Start-End: 187-483
cgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccggtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaata

SEQ ID NO: 165146 - DNA, 591 bp, Homo sapiens
  Payload ID: 12519
  Gene Symbol: PITPNA
  Gene Name: phosphatidylinositol transfer protein, alpha
  ENST ID: ENST00000575895
  CDS Start-End: 246-591
attttgtttttcctgctactttcctgcttggtgtcttgcctttgagtcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccat

SEQ ID NO: 165147 - DNA, 627 bp, Homo sapiens
  Payload ID: 12519
  Gene Symbol: PITPNA
  Gene Name: phosphatidylinositol transfer protein, alpha
  ENST ID: ENST00000574991
  CDS Start-End: 1-627
ggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggtcttccctggtgatctggatgctcaccccaggttgaaagtctctgtcttcaacacggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcga

SEQ ID NO: 165148 - DNA, 571 bp, Homo sapiens
  Payload ID: 12519
  Gene Symbol: PITPNA
  Gene Name: phosphatidylinositol transfer protein, alpha
  ENST ID: ENST00000573056
  CDS Start-End: 209-571
attttgtttttcctgctactttcctgcttggtgtcttgcctttgaggtgatgttttcctcagacccctctgtgtccttcttgcttcctgggggacctttgtggaactagaaaatagctgtttactagcctggagcaaggagcctgagtggtgagccggctgcataaggaaggcacagcagctcatgcttccctaatgcttcactaaacatgcaagacacaaaaggacccagagggctccagcaagggtctggggaccgaacgtctaagcttggaaactggctggacttgtatggtcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattaca

SEQ ID NO: 165149 - DNA, 589 bp, Homo sapiens
  Payload ID: 12519
  Gene Symbol: PITPNA
  Gene Name: phosphatidylinositol transfer protein, alpha
  ENST ID: ENST00000576761
  CDS Start-End: 392-589
ccgggcggcgtcggcagcggcgcgagaggcgacgaggcccgggcggcaggagccggcgcggcgaccgcggcgagggcggcggggacggagcagagcacgacgaagacgcacagtcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaaca

SEQ ID NO: 165150 - DNA, 2826 bp, Homo sapiens
  Payload ID: 12520
  Gene Symbol: PITPNB
  Gene Name: phosphatidylinositol transfer protein, beta
  Uniprot ID: P48739
  ENST ID: ENST00000320996
  CDS Start-End: 65-883
tgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacattacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgcc

SEQ ID NO: 165151 - DNA, 2926 bp, Homo sapiens
  Payload ID: 12520
  Gene Symbol: PITPNB
  Gene Name: phosphatidylinositol transfer protein, beta
  Uniprot ID: P48739
  ENST ID: ENST00000335272
  CDS Start-End: 78-893
cgcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgcca

SEQ ID NO: 165152 - DNA, 590 bp, Homo sapiens
  Payload ID: 12520
  Gene Symbol: PITPNB
  Gene Name: phosphatidylinositol transfer protein, beta
  ENST ID: ENST00000436663
  CDS Start-End: 88-590
agctgtgagggggttccgggaagatggtgctgatcaaggaattgtgagtgggtctgtgggcgcgagcgaggccgtgggacggcagtgatgggagatttgttgatggagaagtgccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagt

SEQ ID NO: 165153 - DNA, 2963 bp, Homo sapiens
  Payload ID: 12520
  Gene Symbol: PITPNB
  Gene Name: phosphatidylinositol transfer protein, beta
  ENST ID: ENST00000455418
  CDS Start-End: 116-931
aggcgcgatggtggctcgggggggcagggaggcggggccgcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattctgcagaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgcc

SEQ ID NO: 165154 - DNA, 884 bp, Homo sapiens
  Payload ID: 12520
  Gene Symbol: PITPNB
  Gene Name: phosphatidylinositol transfer protein, beta
  ENST ID: ENST00000415296
  CDS Start-End: 524-884
actgtattcatagcatagcacttccccaccaccccaaattctccctgctttctttccaagtgagttgtctcctctagactgtgagcttcttgagaacagggactgtgtctgcttctagatgcatccccactgcctagaaccgtgtctgacacagagcaagccagcgacctccgggctgcggctttgaggcccacggcgctttcggtgtaactgcgcgaaccaactcctgaacagcccgctttcctgggtctcgaggccaagggcctcttttctcccagagggcctccgtcgggagtgctggccgctcatcctgccgagtcacagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctata

SEQ ID NO: 165155 - DNA, 1017 bp, Homo sapiens
  Payload ID: 12520
  Gene Symbol: PITPNB
  Gene Name: phosphatidylinositol transfer protein, beta
  Uniprot ID: P48739
  ENST ID: ENST00000634017
  CDS Start-End: 73-894
ccgggaagatggtgctgatcaaggaattgtgagtgggtctgtgggcgcgagcgaggccgtgggacggcagtgatgggagatttgttgatggagaagtgccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacg

SEQ ID NO: 165156 - DNA, 6359 bp, Homo sapiens
  Payload ID: 12521
  Gene Symbol: PITPNC1
  Gene Name: phosphatidylinositol transfer protein, cytoplasmic 1
  ENST ID: ENST00000299954
  CDS Start-End: 875-1675
cccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagagtgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatggatgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgttttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgc

SEQ ID NO: 165157 - DNA, 6182 bp, Homo sapiens
  Payload ID: 12521
  Gene Symbol: PITPNC1
  Gene Name: phosphatidylinositol transfer protein, cytoplasmic 1
  ENST ID: ENST00000580974
  CDS Start-End: 697-1503
gttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatggatgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgttttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttc

SEQ ID NO: 165158 - DNA, 1124 bp, Homo sapiens
  Payload ID: 12521
  Gene Symbol: PITPNC1
  Gene Name: phosphatidylinositol transfer protein, cytoplasmic 1
  Uniprot ID: Q9UKF7
  ENST ID: ENST00000581322
  CDS Start-End: 1-999
atgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtg

SEQ ID NO: 165159 - DNA, 735 bp, Homo sapiens
  Payload ID: 12521
  Gene Symbol: PITPNC1
  Gene Name: phosphatidylinositol transfer protein, cytoplasmic 1
  ENST ID: ENST00000584554
  CDS Start-End: 440-735
caccaggcccagctaattttttttgtatttttagtagagacggggtttcaccgtgttagccaggatggtcttgatctcctgacctcatgatccgcccgcctgggcctcctaaagtgctgcgattacaggcaggagccaccacgctggctatctggctgttctttaggcttcctctttgtctttgaaattctggagcctcagtcctgtgtgcatggattcatttttatttattctgcttagaacttggtattctttacacggagaattcatgacttttacaattctggaatcccatttaccacattgagttctggacatcaaggttctccgggcatcactttctatgctgtgtcatcagtgaagcccataaacttacccgttatcagaaaagcgaagatttcgagatcttgttgagacgtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacac

SEQ ID NO: 165160 - DNA, 713 bp, Homo sapiens
  Payload ID: 12521
  Gene Symbol: PITPNC1
  Gene Name: phosphatidylinositol transfer protein, cytoplasmic 1
  ENST ID: ENST00000584471
  CDS Start-End: 449-713
gtcctccaagcgcggctctgctgtccttctcccgatcctgcgaagccgcgagctccagtattcaggaagtggtgactcagataggattattccggccccggcttccctttcttccccttcttcctccccacctttgtggtgattccacgactgctgagcgtctctgtccagggacagcgagggagcccaaagccaagcaaggcaacgtgaaactcactagtgtggtttggtgtggcaacacacatgaaatcagccacccagaccgtctttatatttaaatctggtgcctcgaaactatcagatatgtttttgagccactacttggtgagaggggcgatgtgctttgggagagaaaaagatgcataactgagaacatggctgagctcacaggggctgtccgtatttgccatctggaccaagggttaagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaacca

SEQ ID NO: 165161 - DNA, 4225 bp, Homo sapiens
  Payload ID: 12522
  Gene Symbol: PITPNM1
  Gene Name: phosphatidylinositol transfer protein, membrane-associated 1
  Uniprot ID: O00562
  ENST ID: ENST00000356404
  CDS Start-End: 227-3961
agggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggctgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccc

SEQ ID NO: 165162 - DNA, 4216 bp, Homo sapiens
  Payload ID: 12522
  Gene Symbol: PITPNM1
  Gene Name: phosphatidylinositol transfer protein, membrane-associated 1
  Uniprot ID: O00562
  ENST ID: ENST00000436757
  CDS Start-End: 220-3951
gcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcccagatgcgcccagcctgtgaacagatctacaacctcttccacgcggctgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 165163 - DNA, 550 bp, Homo sapiens
  Payload ID: 12522
  Gene Symbol: PITPNM1
  Gene Name: phosphatidylinositol transfer protein, membrane-associated 1
  ENST ID: ENST00000524901
  CDS Start-End: 287-550
agtctggggcgcaggtggacggagcgggtctccagggccatggcccgtgggataccaagtggagccactctggcctcagcctgaggagggctcaccccctgggaagaggacggagtggctgcctaggcgcgtggagagccggcgagggccaggggtccaggaaggatgctgggagggggaggtcgaggacccggctgcccaagaaggcagatctggagggcggaggagattaccggtcccggaaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcc

SEQ ID NO: 165164 - DNA, 540 bp, Homo sapiens
  Payload ID: 12522
  Gene Symbol: PITPNM1
  Gene Name: phosphatidylinositol transfer protein, membrane-associated 1
  ENST ID: ENST00000532703
  CDS Start-End: 78-540
gtttcccggggttaggacgcggtcgcagcgggagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaag

SEQ ID NO: 165165 - DNA, 561 bp, Homo sapiens
  Payload ID: 12522
  Gene Symbol: PITPNM1
  Gene Name: phosphatidylinositol transfer protein, membrane-associated 1
  ENST ID: ENST00000533391
  CDS Start-End: 73-561
gcactgactgtcgcgccgtgccctgcgccaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcac

SEQ ID NO: 165166 - DNA, 584 bp, Homo sapiens
  Payload ID: 12522
  Gene Symbol: PITPNM1
  Gene Name: phosphatidylinositol transfer protein, membrane-associated 1
  ENST ID: ENST00000528559
  CDS Start-End: 130-584
agcccttggcgctgtgggcagcctgggcctggagggcgcttcctctggattggcggtgatgcctggcagcatggaaatgccagttcacgaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcga

SEQ ID NO: 165167 - DNA, 4189 bp, Homo sapiens
  Payload ID: 12522
  Gene Symbol: PITPNM1
  Gene Name: phosphatidylinositol transfer protein, membrane-associated 1
  Uniprot ID: O00562
  ENST ID: ENST00000534749
  CDS Start-End: 190-3924
cgcgggcggcggtgctaggctcgcctctgcctccctcgtggcgggcccggacatggggtcccgtggcctgagtccctcggccggcgcgcagggctcggggccgcgcgcagcctccccgcactgactgtcgcgccgtgccctgcgccaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggctgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 165168 - DNA, 6785 bp, Homo sapiens
  Payload ID: 12523
  Gene Symbol: PITPNM2
  Gene Name: phosphatidylinositol transfer protein, membrane-associated 2
  Uniprot ID: Q9BZ72
  ENST ID: ENST00000280562
  CDS Start-End: 207-4238
cctgcaggatgctggcacgtgtgtcctggtcctcaacaaccttctgtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggtcgagaccgtgcagagaaaccctgagctggtcctggagggcggccccctggcccctctcccccacggggacggcttcctggaaaccagtatgcctgttcccgcgcccacctggcaagacgggccccgcccgggctgtgccgagtcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagatcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttc

SEQ ID NO: 165169 - DNA, 6736 bp, Homo sapiens
  Payload ID: 12523
  Gene Symbol: PITPNM2
  Gene Name: phosphatidylinositol transfer protein, membrane-associated 2
  Uniprot ID: Q9BZ72
  ENST ID: ENST00000320201
  CDS Start-End: 140-4189
cctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttc

SEQ ID NO: 165170 - DNA, 6660 bp, Homo sapiens
  Payload ID: 12523
  Gene Symbol: PITPNM2
  Gene Name: phosphatidylinositol transfer protein, membrane-associated 2
  Uniprot ID: Q9BZ72
  ENST ID: ENST00000542749
  CDS Start-End: 65-4114
aaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggctt

SEQ ID NO: 165171 - DNA, 564 bp, Homo sapiens
  Payload ID: 12523
  Gene Symbol: PITPNM2
  Gene Name: phosphatidylinositol transfer protein, membrane-associated 2
  ENST ID: ENST00000542210
  CDS Start-End: 440-564
ccctttccaccgacttgctcctgcagagacatcctgcactcctctccctcccactgaagtgtgggctgggtgcctctccaaacaccccggcctacctgcctcccccacccagagtcgggattcttcaaaggagacctcactggaacatctgtctttgtccacaaccagctctctccccggcctccacctgggagtgaccagagctgctaggatagaccccccacttctggagggaaggcagatgctggcacgtgtgtcctggtcctcaacaaccttctgtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagat

SEQ ID NO: 165172 - DNA, 663 bp, Homo sapiens
  Payload ID: 12523
  Gene Symbol: PITPNM2
  Gene Name: phosphatidylinositol transfer protein, membrane-associated 2
  ENST ID: ENST00000541244
  CDS Start-End: 618-663
gtttagtttggttttggtttgctagtgagcggaaaatctgatgtgacaccttaaaggccagcccacaagtggcagcacctgatcgtcatctctgctctcagcctctatgggaggcacccggccctgccgttgctgctgggcttcctctgccctgagggctttcgtgtgagctcagggcaatgcaagtgtgtgttcagttaccaagcccaaaagtcaaaagaacagccagagccaagctggcttttgaggagagaggccggctcctccagcctggctgcatttgcctgaggtagatcgtgagtgctctgccccagcctctccgccctcctgtgtcctttctcagcggctgctctaaagtataacttcacgtagtggtgacttaacttgaaaggagccgcagggggcgtgagagcagcttggagaggtgggagcctgggccgccgatggctccagcctgtgaaagtgtggaaagctcgttccaggaaaattggaataatcacctcattggctggctttcaggcggggtccttggtgaattttgtcatggttatttaaggaaccttgcctagaagtcccaacttgcagttccccatcgacgggaaggcttggactccaagatgattataaaggaatatcggattcctctgccaatgaccgtggagg

SEQ ID NO: 165173 - DNA, 1793 bp, Homo sapiens
  Payload ID: 12523
  Gene Symbol: PITPNM2
  Gene Name: phosphatidylinositol transfer protein, membrane-associated 2
  ENST ID: ENST00000546049
  CDS Start-End: 280-1716
agaacagggcagaggagaggcctgcagttccagacccacgtcattatggagtctatggtgcccactccccagttggtatctatgctgttccctgagagccccaccatccaccttctctccttttagaggtgcctctggagctaggctgtggacagagcctgctcccctgcccagacactgtggggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcctctgtgatgcctgtcaggcctgtgggtggccctccctgcctcctgccggctcagggcagcctctgggcccttcctctccagttggcggtcaatctggggttttgccttccagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagagatcaaaaataagatcttcaccttgtgcccagcctgtctgctgtccctgaagataaaaagacgaaaagggaggaagcgacagtcgtctaggcagaagtgatgtggccgtggccgacaagatggccccgcgggaggcaggcggagctcagtgtgtccaataaaactgtcttggtagag

SEQ ID NO: 165174 - DNA, 6636 bp, Homo sapiens
  Payload ID: 12524
  Gene Symbol: PREX1
  Gene Name: phosphatidylinositol-3,4,5-trisphosphate-dependent Rac exchange factor 1
  Uniprot ID: Q8TCU6
  ENST ID: ENST00000371941
  CDS Start-End: 24-5003
cggcgccgcgcggccgcgctagaatggaggcgcccagcggcagcgagcccggcggcgacggggccggggactgcgcccacccggacccccgggcccctggcgccgcggcgcccagctccggccccggcccgtgcgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccaagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaa

SEQ ID NO: 165175 - DNA, 4682 bp, Homo sapiens
  Payload ID: 12524
  Gene Symbol: PREX1
  Gene Name: phosphatidylinositol-3,4,5-trisphosphate-dependent Rac exchange factor 1
  ENST ID: ENST00000482556
  CDS Start-End: 1-2651
ggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccaagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaaggtgagcttcaggcctggggcagggaggaccacgggggccgggccaaggccaccaagcacaccggctcccaaccgcctgcccgcccccgacatctcccctcccagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaa

SEQ ID NO: 165176 - DNA, 362 bp, Homo sapiens
  Payload ID: 12524
  Gene Symbol: PREX1
  Gene Name: phosphatidylinositol-3,4,5-trisphosphate-dependent Rac exchange factor 1
  ENST ID: ENST00000620554
  CDS Start-End: 1-39
gaagatgggacaggtagcccctcccccagccttgcctgagccctgcctgagccctgcctgctccctggcactctctctgtttcatttaaatatatttttttcttttatcatgagatgtaatctacctacagaaaagtgcccagagcatagatgcatgaagcgaacatctgggtggttagcattcaagttaagaaataaaacactgcaccccaaatccttcctccttgcaatgccttcttccccctagaagtaaccactgtctgaattttgtgatgatcattttcttgctttttaaagacatttttacctcctaagcatttatgactaaacattttaattaaaatttctatttttgagcctta

SEQ ID NO: 165177 - DNA, 10750 bp, Homo sapiens
  Payload ID: 12525
  Gene Symbol: PREX2
  Gene Name: phosphatidylinositol-3,4,5-trisphosphate-dependent Rac exchange factor 2
  Uniprot ID: Q70Z35
  ENST ID: ENST00000288368
  CDS Start-End: 278-5098
gccagagcagcggggccgggcgcgcagggcctggccggagcccccactcccaggagtttcctctgcagagccccgcgccccccgcgccgggatttcagcccgatcccctcctctccctgcgcccagcctctccccagcatgtaaagtcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggcattcttacacagaatgaaccagtgtgcagcatcaaaagttgacaaaaatgtgacagaagaaacagtgaagatgttgttctcaaacattgaagacatccttgcagtacataaagaattcttaaaagtcgtggaagaatgcttacaccccgaacctaatgctcaacaagaagtgggaacctgctttcttcactttaaagacaagtttcgtatctatgatgaatattgtagtaaccatgagaaggcacaaaaattacttcttgaactcaacaaaataagaacaatccggacatttcttttgaactgcatgctgcttggaggacggaagaacacagatgttcccttggaaggatatttagtaacaccaatacaaagaatatgcaagtaccctcttattttgaaggagttgctgaagcggactccacggaaacacagtgactatgcagcagtgatggaagccctccaagccatgaaagctgtctgttccaacataaacgaggccaagagacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttggattagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagttggatagcaggaagcataattctcatgataaagaaaacaaatcttcggagcaagggaaactgagccctatggtgtacattcagcacaccatcacaaccatggcggccccttcaggtctgtctctgggacagcaggatggccatggtctcaggtatctgctaaaagaagaagacttagaaacccaagacatctatcagaaactgctgggcaaacttcagactgcactgaaagaggtggagatgtgtgtttgtcaaatagatgaccttctgtcttcaataacatattctcctaaattagaacgtaagacatcagagggcataataccaacagacagtgacaatgagaagggagaaagaaacagcaaacgggtatgttttaatgtagcaggagatgaacaggaagattctggtcatgacaccatcagcaacagagactcttacagtgactgcaacagcaataggaattccatcgcctccttcaccagcatctgcagcagccagtgcagctcgtatttccacagtgatgaaatggactcaggtgatgaacttcccttaagtgttcgcatatctcatgataaacaggacaagatacatagttgccttgagcatcttttcagccaggtggattcaattaccaatctcctaaaagggcaggctgttgtgagggcctttgaccaaaccaagtatctcactccaggccgaggattgcaagaatttcaacaggaaatggaaccaaagctgagttgtccaaaaaggctacggcttcatatcaagcaagatccttggaatcttcccagcagcgtccggactcttgctcagaacatcaggaaatttgttgaagaggtaaagtgtaggctactcctggctcttcttgaatattcagatagtgagacacagctccgtagagacatggttttctgccagactcttgtggccactgtctgtgccttctctgagcagctcatggcggccttgaaccagatgtttgacaacagcaaggaaaatgagatggaaacttgggaagccagcaggaggtggctggaccagatagcgaatgcaggtgttctttttcactttcagtcacttctgtcaccaaacttgacagatgaacaagccatgttagaagatacactggttgcactatttgatttggaaaaggtttccttttactttaaaccatcagaagaggaacctctggttgcaaatgttcctcttacatatcaagcagaaggaagtcggcaagctctgaaagtttacttctacattgatagttatcattttgaacaacttcctcaacggctgaaaaatggaggagggtttaaaattcatcctgttctttttgcacaagcactagagagcatggaaggatattattacagagacaatgtttctgtggaagaatttcaagctcagataaatgcagcctcactggaaaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtgcaccctgagcgtgacgctggagcaagccatcattctggccagaagccacggactgccacctcgttacatcatgcaggctacagatgtgatgcggaagcagggagcaagagttcagaacacagcgaagaatttgggagtcagagaccggactccacagtctgcaccaaggctgtacaagctgtgcgagccacctcccccagctggagaagaatgaaaagaactcccaagaaaccaggcaggcagaagctcctgaatgctggactagacaaactacatgctggctaaacattctccactgaagatacatcaatgcttttttttttttttttttctgtaaatctttcttcccattgcaaacaagtagtgatcagtttatactttgatatttatgctggaaatggatagaagttcaatcagacagttcagcttcacgaactgatgtctctctgtattgacattaagtattcacttttagagtaaaatccatccctgggacataaagaaaaaaatattagagatttaaaaattaaccaccatgcctcctctcccattcattaaaatggttttattatgcttgttttcatctttcccaagtggacacatgtaataatggagagttcctcttgaagaaggccattattgaagaaacctggcgacatcttgcaaatcatcatgagaaatgttaaggacaatatagactgtgtgctatacattttcagtcccccatttgcaagagagaaagtcattaatgtgtaaaaggtggaaaagcatgctttactctttctcctaagggcttatttcttattagaggagaagaaagctgactaaggcctccagcaggactcactttcttctagctgcctttgggcatcctttattcttgtggacagctctagcaaatcaatgctatttttggtgtctgcaatgggcatggcttccttgggccatgaatactgggtgctgtgccataatggccctggggatcagggaagtgccctggggatcagggaggggaaccaggatgaagaaggggactgtaagcctattttaaaactaaacctttaagttagatacctaaaactcttaattttatgaaggctctcatatgagaggtcagactcttcaaagaatacaccatcatgagaatttttctgttaagatatatgtataagatatgaaaataaggctttatttgtactttaaaaggaccattaggggacttgtaatttatggatgcacaaggtgtattctatccttattctaaagtatatgtaatgtttatcatttctacattgatgcaataacattgtttttagcatagtaaatacagtaatatttattttaaatccataattttcaaacaaaacactcatgattgtgataattatatgggtttacactaatttagtatgtgaaatgcttttcatatctaaattatgtgcaaactattattaattttttttttattttttgaaactgagtctcactctgttacccagactggagtgcggtggtgcaatcttggctcactgcaacctccacctcctgggttcaagccattctcttgcctcagcctcccaggagctgggactacaggtgtgcaccaccatgctcagctaatttttgtatttttagtagagacgtgttttcaccatgttggccaggctggtcttgaactcctgacatcaagtgatccacccacctcagcctcccaaagtgctaggattacaggcgtgagccgctgctcccggcccattattaaattttaatttatgaaatttgatcatggttttcaaactattattaaaacctttatcattaaccattatgtattgaataacaaaaataccatgttacatgtgtaggcaatatgtgtatactactaggtaaggtaataataattgttatttggcacagaagctctagagacttttgtgagaagtccatatacaatgaaaaacaaggaacctaacatcagagttttcaagaaaaagttgaacattttgaatttaataaagatatctttacaaaaataaccttcaaggatttaacatttgtaggactaataaaggaacacagctgattagctagcaagtcctttcatattgtcatgactgttttctcatcaccatcctggaagcagtaatcctcattagaggcatgcaagggtcattaaaatgatttcagttgtactttgccatatttcatggggcaaattatcagctatattgtggtatttataagctaacatattttatatttttaaggatctactttcttcataatagaatgtgcttcatattatttttagggttaaacataagtgtgtcgtctatcatgcttggtacttactaaatgctcaaaaattagtaatggtttatattaacatcagtcactctaacttctgatcgtaataaaaattgtagctaacacttattaagggattactacatgcccagtaatacctccaaatgctttgcctgtattctgttgttattgcttcacttaatcctcataataatgacgtgacatggtactctttttatcgcgcccatttttagagttgaggaaccaaagcaaagaataacccagtgacttgcacaaagtcacatgattgacaaggggtagaaccaaaatttgaacccaggaagtctgccttcttaatgcattatgctacttttccttatcaatataagaactattgtaatattacgatgatttgtaagtaaatttggagttatgcggcatgtgttgtcattaaattatacatcttgtattaaaaaacggtgaatggaaatatgtaaatgctttaattatatgaaaattatagtgtttcctggacattttacaactctggatgcacattttgaggtaactcaacagtgttgcaatctgaaaaactattttgtatcatgttcctcctcatcaaaaataacagttttagatagtacatctcatacaactttattataattccaacacagtggtaagagtaaaaaacatacctaatggatgaatgaataatgacaattttttcaatgccatatgtacctccatgtgacattgggcattaaatggccttgaggttttaggatgtgtttaccttaatgctacatgctcctctataaccagtgcaccttcaaatactgctaaaacctgctaacttcttccaggttctgagcatggacaactcccaccgccccccaacctaaaagggaaggtcatgcatagaaagtttggattttaacttagagcctgactcaaaaataattgtgaactaaaaattcatagtcaatactttttaagcattctattatctcctataattttttctaatattaattccaaatattacaaaatttaatgtgatattaaagtatgaaaaatttgagaagattagaattttacatgtatttccattcctatttaaagagagaaaatggggagataatttctgtgctagttttacttatattggatatataatattgaatttatagtataagctttattttatcagttcgcaaatctgaagtctcatactgttttctgtctctttaaaacacattcttctggtggcttgggttcattgtgcattcattggccactcttcttgcagcaaattttaaatcaatttaaaattaggtaaactttttatgatactataatatatatgacgttgaaatgacattggttctgagtctattaatttaaattttgggatcattacattcagaatgaaatgaaattgaccttgatactaactttgagagccaaaaaaatgaatgggtaaacaaagcctaagggtcatgttaattaatttaacaaaacacactattttcagtcctttgggcttgtacattttatagacaaaattagcatttattgatttggaagtgttcaattgagagtaaatgactctgtgttttgaaactaatacctttgcatttaaaatactgaagtattattttgttagttgaagtagatcttttcctgtgtagcatgatttaatgcagagcagttattcacttatacttctgaaaagccataatattgaaatttaaaatgaatagtcttactttaaggtcacttttactttacattttactttaaaggtcgtttttagactttatgcactagtggtattgaaactaacctttaatatttgactaaattgcttgtgaatttttggaaactatgtttaatttttaaagacattgttatgtgaattatcttactaaattatcacttaagaactctctcatagcagtaatttcattaacacatatatatactaaccaatttgctaaatgaattgtcggttgtcctgcttaagtactagggccaagctttgaaatgacttaaagtgatctgaattttgattgagaaaaataatctgtcttctatcgaatgtttgaacttttagtgatgagcctcagcaaagtttcaccctgcatgaagcagaacaggtgggggaaaattacaagaggggtctgtaccaaaaatggccccaggatattccattgaacaaatattgaccattatcttcctaggtgctacaactccatactagtcattacagttagtctttggtttcacaaaaatgttactgcttcaaaggcttggcattaacagtgatgtcagcattcatactgccaacagtctgctggtcatacatggaagactgttaaagtgtggtctgtgcatcattgagcaattgttatgtagacacaaggcctgcttcactcaggatagcttgctcctctcgctgagaagagatacctgaagtctactaagtctactaaatgagatatatatgtgtatgtatatgcctatatatattattatatttactagtgtttgtgataatgttataaaaattaataagattgttttgttttgtatgaatgtacgacaaatcgagttgttcaatgtattgaatgaatgtcttactgtaagcatcagagctgtccaaccatgtgtaaatgtacctggtcttttgatcactgacactactttgctgttcaatctggaatcaactgacctggctctgccattgagaaataactaatttagaacaaaattgttaaattttaaaattgcatttctactagaaatagctttggagagttaattttaggtgcgaataacaggataaatgctatctgatcaagcattcatccgaaaaatgtttttgagaattcactttgtgcaaggcacagctgttggggctggtatatgtgtggacatgtttgatttgaaaaccttcgtggtgtctctgtgtgttattgatcatctgtgtcttttgcttaaaatggcattatttgtaacacaaacctaatatcatatatacaaatatactgtatgtagccaagaacactaaattggtaagacgctttagaaaatatgcatttgaatttgaatatctaatgcctcaagcaaatttattagagtttcagatgaatatatatttttgtaactggcaagtaaatgagtagaacagagctttttgcctaaaaatatttttataagtactcatttacatagtattcattattttaaatgacaaaatatcaaattggttctataaatagtaattgttttgaatatatccatacttaacatcatatgaaatccaaaatttaatgataaatttcatctggatgtgttattataaaagtcatctttttttcctttgtaaaatatccatgtaacatagcttccattactccatattttatgtatggttaaaattatcaaagtgcattatgtattttatattgtttatttttgtctgcatgaaagattggaatagtaaccgtgtatgataaatgttaataataataaagtgaaatgtagtatgacc

SEQ ID NO: 165178 - DNA, 9093 bp, Homo sapiens
  Payload ID: 12526
  Gene Symbol: PIK3CA
  Gene Name: phosphatidylinositol-4,5-bisphosphate 3-kinase, catalytic subunit alpha
  Uniprot ID: P42336
  ENST ID: ENST00000263967
  CDS Start-End: 158-3364
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatccatatctccaaagtagaacattaaaccattttaagatatgtctcattcccaagtagtcagagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgtaaagtgtagttcttattaatcaggaaaatgatgacttgattagactgtatatgccctcttggattttattttaaatggattggtgactttcacataggtaaaacacagtccatctgtattcttttttccatcaaaaatcgagtgatttggaattataaaaaaattgtgagcagcctatttgaaaggcatcatggaaatttcacagcacaataacacggatttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgcacaaactgcagacctgggctggacccacatactcaagagtccaccttaagaaattattttgatgtccaagacatcactaaaatatttaagtttaaagataatatgtggtgttaatagattgtggtgcttttactatttaaagacaactttcatacttcagatgtttttgagaagaggggaatgtgaggggagggggcagaacagggaggagttgtttgaatgaattacattctttatatccatcctgctcatttggggcatgtctttaagagaaggctgaaagttgtgagagtatattgtataccgtaagagaatcaactcttcatcatggatgggattgtgaaggctgaactataaaattcagcattgacagcatcctcaattaataattcttggtgacagaataatacagctgggctgttttttaaaatataaacaataccatttttaattattacattaaaaattgtaaatatatctatgtgccatggcctgggaagcctgctttcttttttcataaaaattatttttactgtatgaaaagatcatggggtttagctcaaaatatctgtggtcctgataaaattggattggtaactctacctcagaaggaaaatgggaaaaaaaaatagatgagtcacaattcaatacttcaagctcagaaactgtgcagatcactgaattttagatttataaagtcagagttggcatgccttgtttttaatgatatggaagaccttaagaaaaaaacttggctgaagtttaatcgttggtccagccatttgaaaaaggcaatagtttgaggaggttcccgaattcggcatttgaaattcattttgttctctcttcttcattattagtgcatttggtgtgtgtatacttgcacacaattctgtttgtgtacacactgcttgcttagccctagtcaagaggcatcttttataaaaggtgtaaagaaatatcaaggttctaaaattcggaagagtttagaatttattaggagtttcccaagttgggatgttagtctttaaataaacttcatgcacctattccacttaaggttttgcacctcctttttattagtgcagtgccatttcttctgcttgattttaggtatgttaatattccagccttgctagttagcataaagtgacaggtgtgagccatgaggaaattttctgacttaatttgtacacaactacatataagagttttagtggaggaaaaaaattagtcccttgtgcgtatacagtagttaggtaaatgatttttctaccaacagtatactccattcctcatgtaggtaagtacagaaaaggtttttaaatgtatttttttagccagttaaagtctatgaatctatctgcaaccttatttaatctgtcactataataattttgtggttatgctaagaaccatgtatacttttaggtattcttatttttgtcaatttttctaggttggcaaggaggcagaaaaccttcattgtttcatattaaaatataattagactaaacttaattctagtatgaatttccaaaatcattatctatttatttcatttttatttaattttgtttttatttcatttttaaaagtcccttgttcaatttaacttatgttcctaagagaggttggagaacttggccttcatctgatttcaaaaatgttttgagtttcaaatgaagttaatggtttcagtgtgattcagtcctcagacctaattgggttgaataaaatctaaaagaatatacccttttggagcataacattttaataccttggggaatgtggcactaccaaaagaagactactaacacgtcagatgttcacctggaagctttatcaagaaattcgaaccacccttttggccccattaattgtagcaagtttatttctctatattttgtcattcagtgaattgaagtcctgtggtatactgcattcattagaagaaaaacgtttttaatgtccttttaatgatggcccagaaagcatttgacacagcaagatgcatgtgttactatattgagaatatagaataataacagtatcactaaatttaagacctcttcccagtcttgctgttcctagcaagaagtttggcctgtgactgcacttactgtttatgctcatcagaaactgtcaatgtctgcttttctttaactctgcagtctgtaacatcacgctgtttattaaaaaaaaaaagaaaaatta

SEQ ID NO: 165179 - DNA, 620 bp, Homo sapiens
  Payload ID: 12526
  Gene Symbol: PIK3CA
  Gene Name: phosphatidylinositol-4,5-bisphosphate 3-kinase, catalytic subunit alpha
  ENST ID: ENST00000468036
  CDS Start-End: 267-620
ggagcgcaacaagagggtctttctagaaaacagtctgcatattctttaatgaattagagttgtgatttcatcttggtgaagcttcctcattccagcactgcgcctttgtgcacatgcaggacctgggttttcggaacgatgttttgaatcatagtttgtgtggccggggagaaccccttagaatacttgggtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggt

SEQ ID NO: 165180 - DNA, 245 bp, Homo sapiens
  Payload ID: 12526
  Gene Symbol: PIK3CA
  Gene Name: phosphatidylinositol-4,5-bisphosphate 3-kinase, catalytic subunit alpha
  ENST ID: ENST00000477735
  CDS Start-End: 183-245
ttccgggggattgtaggctctgcccctcctcagctcttaccctcttctgccggaggagggggggggccgagggggtggggaagagttcgttgtttgtttacacgatgtttctgctttgggacaaccatacatctaattccttaaagtagttttatatgtaaaacttgcaaagaatcagaacaatgcctccacgaccatcatcaggtgaactgtggggcatccacttgatgcccccaagaatccta

SEQ ID NO: 165181 - DNA, 5919 bp, Homo sapiens
  Payload ID: 12527
  Gene Symbol: PIK3CB
  Gene Name: phosphatidylinositol-4,5-bisphosphate 3-kinase, catalytic subunit beta
  Uniprot ID: P42338
  ENST ID: ENST00000289153
  CDS Start-End: 17-3229
ggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggaatgggtgagcctcttctttatgggtagactgggcctttggaacttggcactggaactccaagaaatggccaagtcagtagacaaaccaacctcaggaataggctaaggcttattatggcctcttccctgacttctccccttgtttcccagcctcatcaggcatggtataggaggccccctggactttggtgggagcctgaggtaaggagccatgcatatgggaggtgtcctgaagtctgggtagttacttggcactgagccaaggccagactctgctgctttggagctcttgttcatggggcagatgctggagcagtccagttccttggaaataactcagctgaggatgggagttggcccctgaattcctcatttccagggctggtgtagactcactgagacttccaggaatagaactatggaaggacaggtttgttcagagatctttgtctagtagccacccaccatttcatgaaccaggccgcaggtcagtggtttggagaatggtgaacactgccaggaagaaatggataccattctttccagaggggtctcctcagccaaaaggagggccttgataaatacatgccaaatcagtgaagttcaagtcaactgtttttcccatatgggcaccaaattgtatctttcctgttttctttgaagggttaagtaacgtgaccatagtcacagagtagttgatggagccagtattcaaacccagaaagtaagaagcctattttaattatctgtgctctttactcacaatgcctcagtatacatttcagatttattgggttccacaaatagaaatctatggaaattttgaatcaaattgcattaagctatagacaaggttgagacaaattgacatctccagaatattgagttttccaaaatatgtaagtggagtacccatttatttagattatctttcatttatatccgcaatgatttatagtattctgtgtttacatattatgcatcgtttgttagattcctgggtaagtgactttattgtaagtttcattgttgttaatctatagcaatcattctccaagtgtggtcccctgatgaggagcatcagcatcaccagagagaactggttaaaaatgcaaattcttaatttttaatttttgtgagtacatagtagatatatatatggggtacatggaatattttgatacaggcatataacatgtaattatcgcatcagggtaattggggtatccattacctcaagcatttatcctttgtattagaaacaatccagttatactcttttagttattttaagatctataattaaattatcgactatagtt

SEQ ID NO: 165182 - DNA, 690 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000465581
  CDS Start-End: 522-690
tgtattttttagtagagatggggtttcactgtgttagccaggatggtcacgatctcctgacctcgtgatccgtccacctcagccccccagagtgctgggattacaggcatgagccactgtgcccggccaaaaaaaatctctttttaaatatctcctatgattttggttgaatttgttcacctatagaacaaatttatgttgttttctgcttatcattagatgtaaaggagtaaagtccagtgggttctgctggcacattggtggggaagctgagaacttttaaactctttcccctttctccagtgaacaatcgacaggatatgggttatagttacagttaaagggtttattgaactaattgtcactgctgaagttcctgtgccctctgatagcttccttgaaaagttttcatagtttaaaaactctgcttgtccttagcctttgatctcttgctttgatgctcaaacagaagaatgatacaagactgaggatcttgccaggcaagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagc

SEQ ID NO: 165183 - DNA, 2347 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000493568
  CDS Start-End: 1-2108
atgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcc

SEQ ID NO: 165184 - DNA, 4658 bp, Homo sapiens
  Payload ID: 12527
  Gene Symbol: PIK3CB
  Gene Name: phosphatidylinositol-4,5-bisphosphate 3-kinase, catalytic subunit beta
  Uniprot ID: P42338
  ENST ID: ENST00000477593
  CDS Start-End: 75-3287
gggctgctgactgcgcacttggaatagtagcaggcggcggcggcggaacgccaggcagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggaatg

SEQ ID NO: 165185 - DNA, 542 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000462294
  CDS Start-End: 1-542
gtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagc

SEQ ID NO: 165186 - DNA, 904 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000473435
  CDS Start-End: 1-738
ttgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcagtgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaa

SEQ ID NO: 165187 - DNA, 3164 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000469284
  CDS Start-End: 1-105
cattatcctgtagcgtgggtaaatacgatggtttttgactttaaaggacaattgagaactggagacataatattacacagctggtcttcatttcctgattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgtttgttttcccttagatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggaa

SEQ ID NO: 165188 - DNA, 721 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000483968
  CDS Start-End: 328-721
tgtagtgctgcgcggggcaggcgggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagcctttgatctcttgctttgatgctcaaacagaagaatgatacaagactgaggatcttgccaggcaagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaa

SEQ ID NO: 165189 - DNA, 4747 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000462898
  CDS Start-End: 240-644
cgggttcggcggcggcgcgcgcgtgctctgtcggcctgtgcggcgctgcggcggagcgggccatggcagtggggagggggcgagtgtagtgctgcgcggggcaggcgggaggtgatcgagagaggcagggatgggggcgccggagtggagcggttgcggcggcctgggctgctgactgcgcacttggaatagtagcaggcggcggcggcggaacgccaggcagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaa

SEQ ID NO: 165190 - DNA, 667 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000461451
  CDS Start-End: 366-667
tggcgcgcgcgcacacgggcgcgggttcggcggcggcgcgcgcgtgctctgtcggcctgtgcggcgctgcggcggagcgggccatggcagtggggagggggcgagtgtagtgctgcgcggggcaggcgggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtga

SEQ ID NO: 165191 - DNA, 3181 bp, Homo sapiens
  Payload ID: 12527
  Gene Symbol: PIK3CB
  Gene Name: phosphatidylinositol-4,5-bisphosphate 3-kinase, catalytic subunit beta
  ENST ID: ENST00000544716
  CDS Start-End: 249-1814
caggaaagctggaaaagtgcattatcctgtagcgtgggtaaatacgatggtttttgactttaaaggacaattgagaactggagacataatattacacagctggtcttcatttcctgattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgtttgttttcccttagatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 165192 - DNA, 3508 bp, Homo sapiens
  Payload ID: 12528
  Gene Symbol: PIK3CD
  Gene Name: phosphatidylinositol-4,5-bisphosphate 3-kinase, catalytic subunit delta
  ENST ID: ENST00000361110
  CDS Start-End: 116-3322
cctgggagaagaggcagctgaggccgtggcccggagtagtaggagccacaagccaccctgggcaggacgaggccctgagggaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaa

SEQ ID NO: 165193 - DNA, 5203 bp, Homo sapiens
  Payload ID: 12528
  Gene Symbol: PIK3CD
  Gene Name: phosphatidylinositol-4,5-bisphosphate 3-kinase, catalytic subunit delta
  Uniprot ID: O00329
  ENST ID: ENST00000377346
  CDS Start-End: 196-3330
cagtcgctccgagcggccgcgagcagagccgcccagccctgccagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccagtacatctgcagctgcctgcacagtgggttgacccctcacctgaccatggtccattcctcctccatcctcgccatgcgggatgagcagagcaaccctgccccccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaa

SEQ ID NO: 165194 - DNA, 3503 bp, Homo sapiens
  Payload ID: 12528
  Gene Symbol: PIK3CD
  Gene Name: phosphatidylinositol-4,5-bisphosphate 3-kinase, catalytic subunit delta
  ENST ID: ENST00000543390
  CDS Start-End: 116-3322
cctgggagaagaggcagctgaggccgtggcccggagtagtaggagccacaagccaccctgggcaggacgaggccctgagggaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccaagatgctctacctgctgtgtcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagcc

SEQ ID NO: 165195 - DNA, 5483 bp, Homo sapiens
  Payload ID: 12528
  Gene Symbol: PIK3CD
  Gene Name: phosphatidylinositol-4,5-bisphosphate 3-kinase, catalytic subunit delta
  ENST ID: ENST00000536656
  CDS Start-End: 209-3415
ctcgcgcccagcgcagtcgctccgagcggccgcgagcagagccgcccagccctgccagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccaggatgctctacctgctgtgtcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaagaaaaagcctttttatgttcttttatgttctcggctcaaaaagaaacaagggagtgtaggtttaaaaccaaaacaggagagaagacaaaccccgctccggctggagttagttagaaccagaactttattgtagcggatacactttctgacctatcatgagtatacacatctgcgaagggaaaccgcgcggcgaca

SEQ ID NO: 165196 - DNA, 5483 bp, Homo sapiens
  Payload ID: 12528
  Gene Symbol: PIK3CD
  Gene Name: phosphatidylinositol-4,5-bisphosphate 3-kinase, catalytic subunit delta
  ENST ID: ENST00000628140
  CDS Start-End: 209-3415
ctcgcgcccagcgcagtcgctccgagcggccgcgagcagagccgcccagccctgccagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaagaaaaagcctttttatgttcttttatgttctcggctcaaaaagaaacaagggagtgtaggtttaaaaccaaaacaggagagaagacaaaccccgctccggctggagttagttagaaccagaactttattgtagcggatacactttctgacctatcatgagtatacacatctgcgaagggaaaccgcgcggcgaca

SEQ ID NO: 165197 - DNA, 5377 bp, Homo sapiens
  Payload ID: 12529
  Gene Symbol: PIK3CG
  Gene Name: phosphatidylinositol-4,5-bisphosphate 3-kinase, catalytic subunit gamma
  Uniprot ID: P48736
  ENST ID: ENST00000359195
  CDS Start-End: 311-3619
gcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaa

SEQ ID NO: 165198 - DNA, 3828 bp, Homo sapiens
  Payload ID: 12529
  Gene Symbol: PIK3CG
  Gene Name: phosphatidylinositol-4,5-bisphosphate 3-kinase, catalytic subunit gamma
  Uniprot ID: P48736
  ENST ID: ENST00000440650
  CDS Start-End: 86-3394
aactgcaacacttcctctgcatctggatatgaagggagccccagaaaagcggaagaatttagacgcacactgggtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaa

SEQ ID NO: 165199 - DNA, 821 bp, Homo sapiens
  Payload ID: 12529
  Gene Symbol: PIK3CG
  Gene Name: phosphatidylinositol-4,5-bisphosphate 3-kinase, catalytic subunit gamma
  ENST ID: ENST00000473541
  CDS Start-End: 275-821
gacgcacactgggtaggtttgaatttgttttgttttcaaaaattaaacaaatgatccttcagcatcatcgcctccgctgctttatcaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcact

SEQ ID NO: 165200 - DNA, 5197 bp, Homo sapiens
  Payload ID: 12529
  Gene Symbol: PIK3CG
  Gene Name: phosphatidylinositol-4,5-bisphosphate 3-kinase, catalytic subunit gamma
  Uniprot ID: P48736
  ENST ID: ENST00000496166
  CDS Start-End: 144-3452
gcatctggatatgaagggagccccagaaaagcggaagaatttagacgcacactgggtaggtttgaatttgttttgttttcaaaaattaaacaaatgatccttcagcatcatcgcctccgctgctttatcaggtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaa

SEQ ID NO: 165201 - DNA, 8227 bp, Homo sapiens
  Payload ID: 12530
  Gene Symbol: PIK3C2A
  Gene Name: phosphatidylinositol-4-phosphate 3-kinase, catalytic subunit type 2 alpha
  Uniprot ID: O00443
  ENST ID: ENST00000265970
  CDS Start-End: 1-5061
atggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcacaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttttgactttaaacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatgggttaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtttgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaatgttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaagaa

SEQ ID NO: 165202 - DNA, 2101 bp, Homo sapiens
  Payload ID: 12530
  Gene Symbol: PIK3C2A
  Gene Name: phosphatidylinositol-4-phosphate 3-kinase, catalytic subunit type 2 alpha
  ENST ID: ENST00000533645
  CDS Start-End: 166-1617
tttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcacaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaagtaagtttatttaactactgagcaacatccttggaaatttcatttttaatggtttaatctagaaaaatttcaagttaaatttataatgcagaaatacattggatcctattgaattgatttattgaatcaataaacttttattgaaatatataatgtctaagatgtcatgtctaagacagtggtggggtttcagagataagtgagacattgtattcccttaaggagcttgtagtctttacaggaagagtttcaggcagttggttaataagtgatataatgggtctttcttactgtaaagagtcaatagtcacatcattatagactatattcctcttgcaacatgcactgttactttatgcacagtagtcagctgtgatttccttttagttgcctgaaataatcattatatgaatctttttcttacccaggagaattggttgaaaccgggaggcagaggttgcagtgagctgagatcacactgctgcagt

SEQ ID NO: 165203 - DNA, 584 bp, Homo sapiens
  Payload ID: 12530
  Gene Symbol: PIK3C2A
  Gene Name: phosphatidylinositol-4-phosphate 3-kinase, catalytic subunit type 2 alpha
  ENST ID: ENST00000532035
  CDS Start-End: 195-584
agctttcggcggcggctgagccagctgaggggaaaaatggctcggactgtggcggcttcggcggctcaggttgtggtagaggcggaggctcaggcagcttgaggtttatttgtacaaatagcacaggaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacag

SEQ ID NO: 165204 - DNA, 830 bp, Homo sapiens
  Payload ID: 12531
  Gene Symbol: PIK3C2B
  Gene Name: phosphatidylinositol-4-phosphate 3-kinase, catalytic subunit type 2 beta
  ENST ID: ENST00000367184
  CDS Start-End: 310-830
acatccctagagctcagggatttttaaaggccctgctctgagaggtggggctgttcccgctatttatagggactgggagattcctgttcccagctctgagttcctcacacccagctgggcctgctcactgagtcagggcaccctggtaggtggtcacctctgtcactccttctctctcctgcctcccctactccctcacccttccccatcccctgcatgtcatcagagttctgagacagagctcagcccagaatctccttgaagaagcggacacaaagcaaaaagctcttgccagttctgagtggggaaatgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaa

SEQ ID NO: 165205 - DNA, 7686 bp, Homo sapiens
  Payload ID: 12531
  Gene Symbol: PIK3C2B
  Gene Name: phosphatidylinositol-4-phosphate 3-kinase, catalytic subunit type 2 beta
  Uniprot ID: O00750
  ENST ID: ENST00000367187
  CDS Start-End: 558-5462
aaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccgggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatgaaa

SEQ ID NO: 165206 - DNA, 7522 bp, Homo sapiens
  Payload ID: 12531
  Gene Symbol: PIK3C2B
  Gene Name: phosphatidylinositol-4-phosphate 3-kinase, catalytic subunit type 2 beta
  ENST ID: ENST00000424712
  CDS Start-End: 480-5300
aagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccgggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatga

SEQ ID NO: 165207 - DNA, 846 bp, Homo sapiens
  Payload ID: 12531
  Gene Symbol: PIK3C2B
  Gene Name: phosphatidylinositol-4-phosphate 3-kinase, catalytic subunit type 2 beta
  ENST ID: ENST00000415899
  CDS Start-End: 454-846
agtgcgccgggtgtccgggagatggcttcccctctctcgcccgctgctgccgctattgtctcacccggggtggcctgactctgcgagctcgcgcacgctctcggcggagagcacccctccccacccccacaagctggtccttgcgccctttgctgcctctccctctgccccttggagcctagggtctgtgcggagcctggagaggggagcggcccgggagcaggcggcgtgcggccggccagctcctctcgcgctggtgcaagaggcgcctggagccgcagagcgagcccgggaggcgcggagcgagcagcccacgtcgccaggcacaagacacgtcggatgttgcagcagagccagcagctagcgcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacattttt

SEQ ID NO: 165208 - DNA, 727 bp, Homo sapiens
  Payload ID: 12531
  Gene Symbol: PIK3C2B
  Gene Name: phosphatidylinositol-4-phosphate 3-kinase, catalytic subunit type 2 beta
  ENST ID: ENST00000429009
  CDS Start-End: 547-727
ggcttcccctctctcgcccgctgctgccgctattgtctcacccggggtggcctgactctgcgagctcgcgcacgctctcggcggagagcacccctccccacccccacaagctggtccttgcgccctttgctgcctctccctctgccccttggagcctagggtctgtgcggagcctggagaggggagcggcccgggagcaggcggcgtgcggccggccagctcctctcgcgctggtgcaagaggcgcctggagccgcagagcgagcccgggaggcgcggagcgagcagcccacgtcgccaggcacaagacacgtcggatgttgcagcagagccagcagctagcgcagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctggg

SEQ ID NO: 165209 - DNA, 4764 bp, Homo sapiens
  Payload ID: 12532
  Gene Symbol: PIK3C2G
  Gene Name: phosphatidylinositol-4-phosphate 3-kinase, catalytic subunit type 2 gamma
  Uniprot ID: O75747
  ENST ID: ENST00000266497
  CDS Start-End: 39-4376
ggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacaggatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtgagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcatcaattaattcaa

SEQ ID NO: 165210 - DNA, 4840 bp, Homo sapiens
  Payload ID: 12532
  Gene Symbol: PIK3C2G
  Gene Name: phosphatidylinositol-4-phosphate 3-kinase, catalytic subunit type 2 gamma
  Uniprot ID: O75747
  ENST ID: ENST00000433979
  CDS Start-End: 117-4454
tgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacaggatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtgagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcatcaattaattc

SEQ ID NO: 165211 - DNA, 4559 bp, Homo sapiens
  Payload ID: 12532
  Gene Symbol: PIK3C2G
  Gene Name: phosphatidylinositol-4-phosphate 3-kinase, catalytic subunit type 2 gamma
  ENST ID: ENST00000546003
  CDS Start-End: 39-734
ggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagaggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacagctacaaagcgttttcttttacctgttggcttacatatgctggaaagaagctgtgccaagtgagaaactacagaaatattccagacaagaaattattttttttcttggtcaactggaatgaaacgatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtgagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaat

SEQ ID NO: 165212 - DNA, 2497 bp, Homo sapiens
  Payload ID: 12532
  Gene Symbol: PIK3C2G
  Gene Name: phosphatidylinositol-4-phosphate 3-kinase, catalytic subunit type 2 gamma
  ENST ID: ENST00000535651
  CDS Start-End: 548-2299
atagggcaggcaaggggaaggctggtcactccaccctaatcttacaatgcaaatggactttccagttgatcagcaccatcttgtctgcttcttattgtacatatgcctgacaaaaggaagggaagatggagccgccatcttgaacatgtctagtccttagttcctgccacattcacacgtgcaagctcccagcttgcttctctgtgtctgcccctcaactttacaggctgctctttgttagaaaatgatttgggactgcttttcattaaaaaggaaagccttaccgaggactcccatacccttactatctgcctaagtaatttattcttaactcctgtaccagtgagaatcaaattattgagaattgttgagaagcagaaactaactacctggattgtaaaccaaggaaatggtacctgaaaactgccaacggtacctgagaatggagctgacacagagaaaagcacaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacagctacaaagcgttttcttttacctgttggcttacatatgctggaaagaagctgtgccaagtgagaaactacagaaatattccagacaagaaattattttttttcttggtcaactggaatgaaacgtaagtttaatctttactgtatctggatcatttatgtaataaatgtcagctttttccccctttttttaaaagcaagggatgtaatttaaaaaaaatatgctgccagttgatttgattcagtggtatgataagtacactagggctaatagataactgattgttcaattcaacagattaaaagtccatttagaaacctagacaa

SEQ ID NO: 165213 - DNA, 4963 bp, Homo sapiens
  Payload ID: 12532
  Gene Symbol: PIK3C2G
  Gene Name: phosphatidylinositol-4-phosphate 3-kinase, catalytic subunit type 2 gamma
  ENST ID: ENST00000538779
  CDS Start-End: 117-4577
tgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacagctacaaagcgttttcttttacctgttggcttacatatgctggaaagaagctgtgccaagtgagaaactacagaaatattccagacaagaaattattttttttcttggtcaactggaatgaaacgatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtgagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcatcaattaattc

SEQ ID NO: 165214 - DNA, 625 bp, Homo sapiens
  Payload ID: 12532
  Gene Symbol: PIK3C2G
  Gene Name: phosphatidylinositol-4-phosphate 3-kinase, catalytic subunit type 2 gamma
  ENST ID: ENST00000536967
  CDS Start-End: 1-563
aaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaaggttaggacacagcaagaaggaagctgtctgcacacaggaaaagggctctgaccctgattataaactttgcagcctatagaacgaagagaaataaatgtatgttgtttaagcca

SEQ ID NO: 165215 - DNA, 3767 bp, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENST ID: ENST00000349792
  CDS Start-End: 447-2096
ggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttagacctct

SEQ ID NO: 165216 - DNA, 2134 bp, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENST ID: ENST00000368888
  CDS Start-End: 423-2111
gtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcagcatctggaatcaagagacccatggcatctgaggtcttggaagctagacaggattcttacatctcattggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctgg

SEQ ID NO: 165217 - DNA, 3613 bp, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENST ID: ENST00000368890
  CDS Start-End: 445-1947
attttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattccctgcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 165218 - DNA, 3737 bp, Homo sapiens
  Payload ID: 12533
  Gene Symbol: PIP5K1A
  Gene Name: phosphatidylinositol-4-phosphate 5-kinase, type I, alpha
  ENST ID: ENST00000409426
  CDS Start-End: 446-2098
gattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaat

SEQ ID NO: 165219 - DNA, 567 bp, Homo sapiens
  Payload ID: 12533
  Gene Symbol: PIP5K1A
  Gene Name: phosphatidylinositol-4-phosphate 5-kinase, type I, alpha
  ENST ID: ENST00000424999
  CDS Start-End: 444-567
ttttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcaggtttcaactttctgtgctgtggggtcagtggtaagagag

SEQ ID NO: 165220 - DNA, 373 bp, Homo sapiens
  Payload ID: 12533
  Gene Symbol: PIP5K1A
  Gene Name: phosphatidylinositol-4-phosphate 5-kinase, type I, alpha
  ENST ID: ENST00000447555
  CDS Start-End: 70-373
gtcgcgggaaggttgtgataagtccctgatagcctcccgtgcccttttttgacaggtcttcactgattcatgcatcaaatatttactgaactccgtcactgtgcagtgcctaactttgtgcttgaggcaaacaaaacacagatctatttcgaatgccattccgaggaagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctca

SEQ ID NO: 165221 - DNA, 353 bp, Homo sapiens
  Payload ID: 12533
  Gene Symbol: PIP5K1A
  Gene Name: phosphatidylinositol-4-phosphate 5-kinase, type I, alpha
  ENST ID: ENST00000418435
  CDS Start-End: 94-353
aagagagaatctcttatatgtgctgatacaggtttcaactttctgtgctgtggggtcagtggtaagagagcagcatctggaatcaagagacccatggcatctgaggtcttggaagctagacaggattcttacatctcattggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccag

SEQ ID NO: 165222 - DNA, 2297 bp, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENST ID: ENST00000441902
  CDS Start-End: 445-2013
attttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccagtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctc

SEQ ID NO: 165223 - DNA, 540 bp, Homo sapiens
  Payload ID: 12533
  Gene Symbol: PIP5K1A
  Gene Name: phosphatidylinositol-4-phosphate 5-kinase, type I, alpha
  ENST ID: ENST00000454769
  CDS Start-End: 273-392
ttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcaggtaagcccggcagggcgtgggtagggagctggtgaggaatatgcgatgggaggaagagcgagacctaagagggtacctgtagctgggaatgtcctacgtgttaccgcagcatctggaatcaagagacccatggcatctgaggtgccttatgcctctggcatgcccatcaagaaaataggccat

SEQ ID NO: 165224 - DNA, 2654 bp, Homo sapiens
  Payload ID: 12534
  Gene Symbol: PIP5K1B
  Gene Name: phosphatidylinositol-4-phosphate 5-kinase, type I, beta
  Uniprot ID: O14986
  ENST ID: ENST00000265382
  CDS Start-End: 306-1928
aacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctca

SEQ ID NO: 165225 - DNA, 612 bp, Homo sapiens
  Payload ID: 12534
  Gene Symbol: PIP5K1B
  Gene Name: phosphatidylinositol-4-phosphate 5-kinase, type I, beta
  ENST ID: ENST00000377284
  CDS Start-End: 302-612
gctgaacccaagagactgatgtattgcccagactcctgcacgctgtctgccagccacagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatga

SEQ ID NO: 165226 - DNA, 791 bp, Homo sapiens
  Payload ID: 12534
  Gene Symbol: PIP5K1B
  Gene Name: phosphatidylinositol-4-phosphate 5-kinase, type I, beta
  ENST ID: ENST00000437200
  CDS Start-End: 305-791
cgaaagcccaccaatccattgtggaatgacctctacaaatagttttgcttctgcacaaccagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatc

SEQ ID NO: 165227 - DNA, 813 bp, Homo sapiens
  Payload ID: 12534
  Gene Symbol: PIP5K1B
  Gene Name: phosphatidylinositol-4-phosphate 5-kinase, type I, beta
  ENST ID: ENST00000440050
  CDS Start-End: 343-813
agtgcattccaagttctaaacagctgagttttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatg

SEQ ID NO: 165228 - DNA, 3335 bp, Homo sapiens
  Payload ID: 12534
  Gene Symbol: PIP5K1B
  Gene Name: phosphatidylinositol-4-phosphate 5-kinase, type I, beta
  Uniprot ID: O14986
  ENST ID: ENST00000478500
  CDS Start-End: 343-1992
agtgcattccaagttctaaacagctgagttttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagacacaagtgaaaaaccaaatcctgtctcgtttacccaagattccgtgtacattcattcaagcatggaccaacacagagatgattacgttgctagcctgttattacttcagatcagtttcaactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacaggttcaagatggcaacatcagagcattaaactaagcaagcagtcctgtgtgtggctcacacctgtaatcccagcactttgcgaggccgaggcagactgatctcttgagtccggaagttcaagaccagcctgggcaatatgctcaatccatctgagcacctgttattcatatcagaaggaaatgaaatcaatagcattttcttccccagtggcagtctttaaacttccttctcttttgccagatgagaaggttcagcctagttcttcagtggttccatacttaaaccatccaaaaatacagaaaaacatcaagcaacccaaatcatgtgggacattctgcagtatacctgatgagtactcttcagaactgtcaaggtcatcaaaaacaagaagtctaaaaaaccatcacagtctatgagagcctaaggagatgtgacacctaaatgtcacatggtatccagagtgggactctggaacggaaaaaggcattaaggaaaatgaacaaaatctggatatagtatggagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaa

SEQ ID NO: 165229 - DNA, 2664 bp, Homo sapiens
  Payload ID: 12534
  Gene Symbol: PIP5K1B
  Gene Name: phosphatidylinositol-4-phosphate 5-kinase, type I, beta
  Uniprot ID: O14986
  ENST ID: ENST00000541509
  CDS Start-End: 435-1943
ctgctccgtctggccggaggaccggcggggaaggaaggggaaagcggggacacacacactcgccgcggcgcgcgcgcactgcacactcgtagccgcgcgcccccgccaaggcgcgtccggagcgagtttggccccgcggctccagccccggcacctgcccgccctcagcgttgcccccggccccggccccgcccgccgccccctccgccctcccgcccctcccgcccctcccgcccctcgcctgcactgctctcccttcgctgtggggaagcgacaacgtcccgataacttgcagactgtggcgcaactggtcttggtagcggaggcacccgaatgctgcccgggtgagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctc

SEQ ID NO: 165230 - DNA, 5080 bp, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENST ID: ENST00000335312
  CDS Start-End: 90-2096
ctcccttggccggcggcgcttgttgttcggcggcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctactttcccaccgatgagaggagctgggtgtactccccgctccactatagcgcccaggcccccccggcctccgacggcgagagcgacacataatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcccggaaggcccctgctgtggagaagccggacccatccccgaggtccccagcgaggacacacactccacgagagcagcccctccactctgcccaggagaggggccgaccctcctcgggaaccggccagccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccttttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagca

SEQ ID NO: 165231 - DNA, 3326 bp, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENST ID: ENST00000537021
  CDS Start-End: 1-2103
atggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttggcgcctctggggtccccatgcacccacctggccctggagaagggagggacgggccgcgtgcctgtgcccctacccaccgcacgtcgtcaccccttttcctgggactggtttgtgcgcgtcctggtctccggatggtacggggggcctgggggccatgtcgtgctgtgtgtctgtgtcctgatgccctgccaggtgggcagcagagaagggagaagggtcctcggtcctgcccctgccccggcaccccccaccttctgcttggcagtcagctgtccccacctgctccccgccacctccctccgcctctcccacccgaccacgggggtggccgcctcatccgctgtcctctgttttccttcctcctccggcccacccggcccgccccgtccagttcacggatgggaggtactggatttactctccccgccatcgccgactgcgggccgtgacgctgagcgcctcggggactgtaagtgaccgcagccggccaccctggggagaaggggcagtgcccctcgggcagcagggagccgcaggtccccggccggaagctcagtgtctgacgtcagttgttttccagaagggctttgggtaaatcacggctgcaattgaggtcagccacgctggccccggaccaggcgctgggctgcatgcgtcactgggaatgtcattcggtcccacgtcgaaccgggcgctccatagggcagcaccatcaccaggtgcacagctgaggcccagggtctgcttcggaccccggccagaccccagcgagcccctctctgcccctggacccagccctctcgtgtcagggtgtcttgggtggacgcttctcactcgtgcagacctggctgcccgtggccccgctggctgcacaggggaggttgcacaggtcagcagagtggctgcagggccgggctctgaaccgcagggccatggagacggggaggagatggtctctccacacccacctcacagatggaggcgctgaggcctcggctcccctgggagcctgggagaccacacggtttagtcaaaatccagatccccaagctctcaaggaggtccccctgggacgccacatgggccccacgtagctgtgagatcctcagggcctgctgttgtcattatgaccaataagcaaggggcccagagagcctaagagacctgcccagcaccgcacagccagaacggggcgcagacccaaagcaggagtgtcccctcgagacaaagcctccgccgaggccgccgtgactccccgcccatcagcaaacctctccgagcacctctgtgtgccaggcactgtggagtgaccccaagaggtggagaccacttccccggctgctctaggcagctccgtcccacggagccagcgggaagccagccaccgcgaagccgtgccccgga

SEQ ID NO: 165232 - DNA, 2289 bp, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENST ID: ENST00000539785
  CDS Start-End: 76-1998
ggcgcttgttgttcggcggcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttaatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgtttt

SEQ ID NO: 165233 - DNA, 2933 bp, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENST ID: ENST00000589578
  CDS Start-End: 1-2124
atggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctactttttcacggatgggaggtactggatttactctccccgccatcgccgactgcgggccgtgacgctgagcgcctcggggactgtaagtgaccgcagccggccaccctggggagaaggggcagtgcccctcgggcagcagggagccgcaggtccccggccggaagctcagtgtctgacgtcagttgttttccagaagggctttgggtaaatcacggctgcaattgaggtcagccacgctggccccggaccaggcgctgggctgcatgcgtcactgggaatgtcattcggtcccacgtcgaaccgggcgctccatagggcagcaccatcaccaggtgcacagctgaggcccagggtctgcttcggaccccggccagaccccagcgagcccctctctgcccctggacccagccctctcgtgtcagggtgtcttgggtggacgcttctcactcgtgcagacctggctgcccgtggccccgctggctgcacaggggaggttgcacaggtcagcagagtggctgcagggccgggctctgaaccgcagggccatggagacggggaggagatggtctctccacacccacctcacagatggaggcgctgaggcctcggctcccctgggagcctgggagaccacacggtttagtcaaaatccagatccccaagctctcaaggaggtccccctgggacgccacatgggccccacgtagctgtgagatcctcagggcctgctgttgtcattatgaccaataagcaaggggcccagagagcctaagagacctgcccagcaccgcacagccagaacggggcgcagacccaaagcaggagtgtcccctcgagacaaagcctccgccgaggccgccgtgactccccgcccatcagcaaacctctccgagcacctctgtgtgccaggcactgtggagtgaccccaagaggtggagaccacttccccggctgctctaggcagctccgtcccacggagccagcgggaagccagccaccgcgaagccgtgccccgga

SEQ ID NO: 165234 - DNA, 1104 bp, Homo sapiens
  Payload ID: 12536
  Gene Symbol: PIP5KL1
  Gene Name: phosphatidylinositol-4-phosphate 5-kinase-like 1
  Uniprot ID: Q5T9C9
  ENST ID: ENST00000300432
  CDS Start-End: 211-786
gtttaggggtgggatcgggtcgggatccggaccagccaaggaagggtccaggtgccgcggatcttgagaaggaggcgtggcctggcgctgggattggcgccggatgcaccccgggttgtggagtttggggatcctcatccggcgccctctccccttccaggagtgcacagtctgcgggtggaccggggaaagaagacgtacttcatcgtcatgcagagcgtcttctaccccgccggccgcatctccgagaggtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaa

SEQ ID NO: 165235 - DNA, 2198 bp, Homo sapiens
  Payload ID: 12536
  Gene Symbol: PIP5KL1
  Gene Name: phosphatidylinositol-4-phosphate 5-kinase-like 1
  Uniprot ID: Q5T9C9
  ENST ID: ENST00000388747
  CDS Start-End: 46-1230
gcggcggggaatgcggccaaagcccgggaagctgctgcgggggcgatggctgcgccgagcccggggccccgcgaggtcctggccccctcccctgaggctggatgcagagcagtcacctccagccggcgggggcttctctggcgcctccgagacaagcagtctcgcctgggcctgtttgagatcagcccggggcatgaactgcatgggatgacgtgcatgatgcaggcagggctgtgggctgccacccaggtctccatggaccacccacccacggggccgccctcccgggacgatttctcggaggtcctaacccaggttcacgagggcttcgagctgggcacgctggccggccccgcctttgcctggctgcgccgctccctgggcctggcggaggaggactatcaggctgccctgggccccggcggcccctacctgcagttcctcagcacctccaagagcaaggccagcttcttcctgtcccacgaccagcgcttcttcctgaagacccaggggcgccgagaggtgcaggctctgctcgcccacctgccccgctacgtgcagcacctgcagcggcacccgcactcgctgctggcgcggttgctgggagtgcacagtctgcgggtggaccggggaaagaagacgtacttcatcgtcatgcagagcgtcttctaccccgccggccgcatctccgagaggtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgcca

SEQ ID NO: 165236 - DNA, 1319 bp, Homo sapiens
  Payload ID: 12537
  Gene Symbol: PIP4K2A
  Gene Name: phosphatidylinositol-5-phosphate 4-kinase, type II, alpha
  ENST ID: ENST00000323883
  CDS Start-End: 56-856
ttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagatggccaatctaaaagccactttcacttttcccaagccaactggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaatgaacacacgtgtgggggaggggagaaggaagtgcatgatgtcaggcaccgtgttggcatcacacaacaaactgtggatcagt

SEQ ID NO: 165237 - DNA, 3802 bp, Homo sapiens
  Payload ID: 12537
  Gene Symbol: PIP4K2A
  Gene Name: phosphatidylinositol-5-phosphate 4-kinase, type II, alpha
  Uniprot ID: P48426
  ENST ID: ENST00000376573
  CDS Start-End: 230-1450
gcggcgggcgcaggatacgggccggggcgcgagccgagcgcagtctgccgggccgagcgggcggagcgagccgagtggggctgagcgcgccggcggcggcgggcggagcggagcgcggcgcgccggggccgccgccggggggatgcggctgcctccccgggccggggtgtagagagggcgggtccccggcctcgggagcacggcggtggaggggacataggaggcggccatggcgacccccggcaacctagggtcctctgtcctggcgagcaagaccaagaccaagaagaagcacttcgtagcgcagaaagtgaagctgtttcgggccagcgacccgctgctcagcgtcctcatgtggggggtaaaccactcgatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaatgaacacacgtgtgggggaggggagaaggaagtgcatgatgtcaggcaccgtgttggcatcacacaacaaactgtggatcagttttttttttttttttttttttttggagttgaaagatgtgagacagtattcagaataatgaagataataatgatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagccttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccaaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggatttttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagctgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcacaagatgaatccttttttcctctgtcccaattgtgtgtctctgttccaaacacattttaaatactcggtcctgacagtgtctttagctaatccttgaagaaatgaaagtggaattgaatcttt

SEQ ID NO: 165238 - DNA, 1436 bp, Homo sapiens
  Payload ID: 12537
  Gene Symbol: PIP4K2A
  Gene Name: phosphatidylinositol-5-phosphate 4-kinase, type II, alpha
  Uniprot ID: P48426
  ENST ID: ENST00000545335
  CDS Start-End: 207-1250
gcagctgctgcggggcggggagccggagtcagccctggacctccggctgctcgcccgcctcgaagcccccagccccgcggcgcgtgcccccagccctctgggccgcccaggcaccaccacttgcgtcccctttagatctatggcccggtgcgggtcgggggtcccgtgtgcatatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagca

SEQ ID NO: 165239 - DNA, 443 bp, Homo sapiens
  Payload ID: 12537
  Gene Symbol: PIP4K2A
  Gene Name: phosphatidylinositol-5-phosphate 4-kinase, type II, alpha
  ENST ID: ENST00000604912
  CDS Start-End: 18-443
gtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaac

SEQ ID NO: 165240 - DNA, 547 bp, Homo sapiens
  Payload ID: 12538
  Gene Symbol: PIP4K2B
  Gene Name: phosphatidylinositol-5-phosphate 4-kinase, type II, beta
  ENST ID: ENST00000617499
  CDS Start-End: 334-547
gtgccccgcgggtggagcgcgcccggggcccagcagagtgggcagatccacgcttaggtggagcgagggggcgttccttggctttctaggctggactttctcttccccttgctgcgtccctcctctcccccggggtgggcatggccttcccacctcacagggagcagtgggactcaaacagcaggagaaggagaaagcaagatatggaaaggaggagtaaacaccggtagatttattggctcctgtggccctctcttcctctctggagttgcagttcttgctttggacctcctcggtcctatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtg

SEQ ID NO: 165241 - DNA, 5734 bp, Homo sapiens
  Payload ID: 12538
  Gene Symbol: PIP4K2B
  Gene Name: phosphatidylinositol-5-phosphate 4-kinase, type II, beta
  Uniprot ID: P78356
  ENST ID: ENST00000613180
  CDS Start-End: 482-1732
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagagccagagagctggatatggggtcggggatcgggagttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaatttttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcattgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaca

SEQ ID NO: 165242 - DNA, 5734 bp, Homo sapiens; identical to SEQ ID NO: 165241
  Payload ID: 12538
  Gene Symbol: PIP4K2B
  Gene Name: phosphatidylinositol-5-phosphate 4-kinase, type II, beta
  Uniprot ID: P78356
  ENST ID: ENST00000619039
  CDS Start-End: 482-1732

SEQ ID NO: 165243 - DNA, 547 bp, Homo sapiens; identical to SEQ ID NO: 165240
  Payload ID: 12538
  Gene Symbol: PIP4K2B
  Gene Name: phosphatidylinositol-5-phosphate 4-kinase, type II, beta
  ENST ID: ENST00000631946
  CDS Start-End: 334-547

SEQ ID NO: 165244 - DNA, 2924 bp, Homo sapiens
  Payload ID: 12539
  Gene Symbol: PIP4K2C
  Gene Name: phosphatidylinositol-5-phosphate 4-kinase, type II, gamma
  Uniprot ID: Q8TBX8
  ENST ID: ENST00000354947
  CDS Start-End: 17-1282
ggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaa

SEQ ID NO: 165245 - DNA, 1558 bp, Homo sapiens
  Payload ID: 12539
  Gene Symbol: PIP4K2C
  Gene Name: phosphatidylinositol-5-phosphate 4-kinase, type II, gamma
  Uniprot ID: Q8TBX8
  ENST ID: ENST00000422156
  CDS Start-End: 117-1238
gtccgctgtccggcctccggtcacgtgacagcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttgtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatatagg

SEQ ID NO: 165246 - DNA, 2876 bp, Homo sapiens
  Payload ID: 12539
  Gene Symbol: PIP4K2C
  Gene Name: phosphatidylinositol-5-phosphate 4-kinase, type II, gamma
  Uniprot ID: Q8TBX8
  ENST ID: ENST00000540759
  CDS Start-End: 88-1353
agcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaa

SEQ ID NO: 165247 - DNA, 1532 bp, Homo sapiens
  Payload ID: 12539
  Gene Symbol: PIP4K2C
  Gene Name: phosphatidylinositol-5-phosphate 4-kinase, type II, gamma
  Uniprot ID: Q8TBX8
  ENST ID: ENST00000550465
  CDS Start-End: 48-1259
gatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctccc

SEQ ID NO: 165248 - DNA, 941 bp, Homo sapiens
  Payload ID: 12539
  Gene Symbol: PIP4K2C
  Gene Name: phosphatidylinositol-5-phosphate 4-kinase, type II, gamma
  ENST ID: ENST00000550095
  CDS Start-End: 25-540
acttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtgattcaacgtgtgaatgagagacaggaaatggatttcttgctgattactttcctgagaaggttggctgtgaagagaaagaggcagcaacacagaaagagagatgtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtgga

SEQ ID NO: 165249 - DNA, 608 bp, Homo sapiens
  Payload ID: 12539
  Gene Symbol: PIP4K2C
  Gene Name: phosphatidylinositol-5-phosphate 4-kinase, type II, gamma
  ENST ID: ENST00000550360
  CDS Start-End: 45-197
agctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtggatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacag

SEQ ID NO: 165250 - DNA, 403 bp, Homo sapiens
  Payload ID: 12539
  Gene Symbol: PIP4K2C
  Gene Name: phosphatidylinositol-5-phosphate 4-kinase, type II, gamma
  ENST ID: ENST00000548264
  CDS Start-End: 1-403
cgcttctgccccagttcctggggatgtaccgagtcagtgtggacaacgaagacagctacatgcttgtgatgcgcaatatgtttagccaccgtcttcctgtgcacaggaagtatgacctcaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcac

SEQ ID NO: 165251 - DNA, 548 bp, Homo sapiens
  Payload ID: 12539
  Gene Symbol: PIP4K2C
  Gene Name: phosphatidylinositol-5-phosphate 4-kinase, type II, gamma
  ENST ID: ENST00000551772
  CDS Start-End: 69-548
gcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaagatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgctt

SEQ ID NO: 165252 - DNA, 5507 bp, Homo sapiens
  Payload ID: 12540
  Gene Symbol: PLCXD1
  Gene Name: phosphatidylinositol-specific phospholipase C, X domain containing 1
  Uniprot ID: Q9NUJ7
  ENST ID: ENST00000381657
  CDS Start-End: 515-1486
gccttttccagctggctgcagagaaggggccagctccctcctggggacccggagccgcggtacaggtgtggttgcttctcttggagaaagaggctgagctgacatcccccgggctgataaagaatgggctcctcctcctgggcccagcaggctcccgggaccctccctccctccctccctccctccctccttccgggcagcagggaagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaaatagagatggggtggctgggcgtggtgacttcgcctgtcttcccagcactttgggaggccgaggtgggtggatcatgaggtcaggagcttgagagcagcctgaccaacatggtgaaatcccatctctactaaaaatacaaaacttagctgggtgtgtggcaggcgcctgtagtcccagttactcgggaggctcaggcaggagaactgcttgaagccgggagatggaggttgcattgagctgacatcgtgccactgcactccagtctgaatgatagaccgagactccatctcaaaagaaaaaaaaacagccgagtgtgcagtgactcacgcctgtcatcccagcactttgggaggcgaaggcgggtggaacatgaggtcaggagttcgagaccagcctgaccaacatggtgaaaccccgtctctattaaaaacacaaaaactacctgggtgcgtgatgggcacctgtagtgccagctactcaggaggctgaggcaggagaatggcgtgaacccgggaggtggaggttgcattgagctgagatcgtgccactgcactccagcctgggcgacagagcgagactccatctcaaaaaaaaaaaaaaaaaaaaagatggggtctctctatgttggccaggttggtcttgaactcctggcctcaagtgatcctcccacctcagcctcccagagtgctgggatgacagtcaagaaccaccatggcagcccataatatgttttcttatttctgtattctccttgctgtggcgtctggagcccttacagacccagggagacactatcctcccacagctcactaattactaaacacagtgacagcccacttaggagccggcctcccctgtcagccaacccctcagctagttctcacaccaagcctatagatatatatgtgtgtgtatatatgtgtgtttatgtgtctgtgtgtatatatgtgtatatatcggtgtgtatatatgtatgtatgtttatacatgtgtatatgtgtgtgtgtgtgtgtatatgtgtgtatgtgtgtatatatgtatatgtgtgcatatgtgtatacgtgtatgcatacatgtatatgtgtatgcatgtatatgtgtatgtgtacatgtatatgtgtttatacatgtatatgtgtgtatgcgtgtatacgtgtatgtatacatgtatatgtgtgtatgcgtgtatatacacacgtatacatatatacgtgcgtgtgtatgtgtatatatatatatgtgtatatatatattttttgaggagtctcactctgtcacccaggctggagtgcaacggcgagatctcggctcaccgcaacctccgcctccctggttcaagcaattctcctgcctccgcctcccgagtagctgggatgacaggcatgtgccaccacacccgactaatttcatatatttagtagagacggggtttctccgcgttggtcaggccgttctcaaacttctgacctcaggtgatctgcccgcctcgacctcccaaagtgctgggatgacaggcatgagccactgtgcccagccgccgatatttctttaaattatgtttagggacagggtctttttctgtcacccaggctggagggcagtggtacagtcatagctcactgcagcctcaacctcctgggctcaagcgatcctctcagctcagcctcccgtgtagctggggctccagggacacacccccactgctggctaatttttgtatttttggtagagtcagggtttcaccacatggcacagtctggtctcaaattcctgggctccagtgatcctcccaccttagcttccagagtggccaggatcacaggcaggcaccaccatgcccaggtaattttatttttttgtagagacgtggtctggctatgttgtccagggtggtctcaaactcctgggctcaactgatcctcccacctcaacctctgccatagccaggacctcaggtgtcagccaccacacccacagctaattttttttgtagagatggggtctggctctgttgctcaggctggtgtgtagtaggggcacagtcatagctcactgtaaccttcaacgcctgggctgaagcaattctcccgcctcagcttcccaagtaactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccaggttcaagcaattcttgtgcctcagcctcctgagtagctgggattacaggcgcccgccaccgcgcctggctaacttttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctactgaagtgttcaaaagttgtcaatcctcagccgttccctagtcctgttgcccggttctgccgaagccccttgaaggctgtggcctgggctgttccctcattcattcctgcctcccgagccaaacccaggtatccgcttgtgccctgcgtggtgtggcagcgtcttctctcgggaagggtcaggagtaatttcttctttcagtggcctctctgtgctagtcccggtcacctccgtgaattaaagtcctacaggtacaagggagaccccccccccacggaaggcgcccccagtccgtgtgggagactcgcacaccggttttctgcacaggtttctttctgcctctgaagcgtgaacggtcctagtttcagacgcagatcctgcaaatacttttttttgtttttttgagatggattttccctcttgttgttcaggctggagtgcaatggcacgatctcagctcactgcaacctctgcctcccgggttcaagtgattctcctgcctcagcctcccgaggagctgagattacaggcgcgtgccaccgtgcctggttaattttgtatttgtatttttatttatgttttgagacggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaa

SEQ ID NO: 165253 - DNA, 1863 bp, Homo sapiens
  Payload ID: 12540
  Gene Symbol: PLCXD1
  Gene Name: phosphatidylinositol-specific phospholipase C, X domain containing 1
  Uniprot ID: Q9NUJ7
  ENST ID: ENST00000381663
  CDS Start-End: 245-1216
aataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtc

SEQ ID NO: 165254 - DNA, 5287 bp, Homo sapiens
  Payload ID: 12540
  Gene Symbol: PLCXD1
  Gene Name: phosphatidylinositol-specific phospholipase C, X domain containing 1
  Uniprot ID: Q9NUJ7
  ENST ID: ENST00000399012
  CDS Start-End: 298-1269
gtgttttaggaagagtgtcccgcagagacccggcgggagctgccaggagctctgggattccagcggctggaagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaaatagagatggggtggctgggcgtggtgacttcgcctgtcttcccagcactttgggaggccgaggtgggtggatcatgaggtcaggagcttgagagcagcctgaccaacatggtgaaatcccatctctactaaaaatacaaaacttagctgggtgtgtggcaggcgcctgtagtcccagttactcgggaggctcaggcaggagaactgcttgaagccgggagatggaggttgcattgagctgacatcgtgccactgcactccagtctgaatgatagaccgagactccatctcaaaagaaaaaaaaacagccgagtgtgcagtgactcacgcctgtcatcccagcactttgggaggcgaaggcgggtggaacatgaggtcaggagttcgagaccagcctgaccaacatggtgaaaccccgtctctattaaaaacacaaaaactacctgggtgcgtgatgggcacctgtagtgccagctactcaggaggctgaggcaggagaatggcgtgaacccgggaggtggaggttgcattgagctgagatcgtgccactgcactccagcctgggcgacagagcgagactccatctcaaaaaaaaaaaaaaaaaaaaagatggggtctctctatgttggccaggttggtcttgaactcctggcctcaagtgatcctcccacctcagcctcccagagtgctgggatgacagtcaagaaccaccatggcagcccataatatgttttcttatttctgtattctccttgctgtggcgtctggagcccttacagacccagggagacactatcctcccacagctcactaattactaaacacagtgacagcccacttaggagccggcctcccctgtcagccaacccctcagctagttctcacaccaagcctatagatatatatgtgtgtgtatatatgtgtgtttatgtgtctgtgtgtatatatgtgtatatatcggtgtgtatatatgtatgtatgtttatacatgtgtatatgtgtgtgtgtgtgtgtatatgtgtgtatgtgtgtatatatgtatatgtgtgcatatgtgtatacgtgtatgcatacatgtatatgtgtatgcatgtatatgtgtatgtgtacatgtatatgtgtttatacatgtatatgtgtgtatgcgtgtatacgtgtatgtatacatgtatatgtgtgtatgcgtgtatatacacacgtatacatatatacgtgcgtgtgtatgtgtatatatatatatgtgtatatatatattttttgaggagtctcactctgtcacccaggctggagtgcaacggcgagatctcggctcaccgcaacctccgcctccctggttcaagcaattctcctgcctccgcctcccgagtagctgggatgacaggcatgtgccaccacacccgactaatttcatatatttagtagagacggggtttctccgcgttggtcaggccgttctcaaacttctgacctcaggtgatctgcccgcctcgacctcccaaagtgctgggatgacaggcatgagccactgtgcccagccgccgatatttctttaaattatgtttagggacagggtctttttctgtcacccaggctggagggcagtggtacagtcatagctcactgcagcctcaacctcctgggctcaagcgatcctctcagctcagcctcccgtgtagctggggctccagggacacacccccactgctggctaatttttgtatttttggtagagtcagggtttcaccacatggcacagtctggtctcaaattcctgggctccagtgatcctcccaccttagcttccagagtggccaggatcacaggcaggcaccaccatgcccaggtaattttatttttttgtagagacgtggtctggctatgttgtccagggtggtctcaaactcctgggctcaactgatcctcccacctcaacctctgccatagccaggacctcaggtgtcagccaccacacccacagctaattttttttgtagagatggggtctggctctgttgctcaggctggtgtgtagtaggggcacagtcatagctcactgtaaccttcaacgcctgggctgaagcaattctcccgcctcagcttcccaagtaactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccaggttcaagcaattcttgtgcctcagcctcctgagtagctgggattacaggcgcccgccaccgcgcctggctaacttttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctactgaagtgttcaaaagttgtcaatcctcagccgttccctagtcctgttgcccggttctgccgaagccccttgaaggctgtggcctgggctgttccctcattcattcctgcctcccgagccaaacccaggtatccgcttgtgccctgcgtggtgtggcagcgtcttctctcgggaagggtcaggagtaatttcttctttcagtggcctctctgtgctagtcccggtcacctccgtgaattaaagtcctacaggtacaagggagaccccccccccacggaaggcgcccccagtccgtgtgggagactcgcacaccggttttctgcacaggtttctttctgcctctgaagcgtgaacggtcctagtttcagacgcagatcctgcaaatacttttttttgtttttttgagatggattttccctcttgttgttcaggctggagtgcaatggcacgatctcagctcactgcaacctctgcctcccgggttcaagtgattctcctgcctcagcctcccgaggagctgagattacaggcgcgtgccaccgtgcctggttaattttgtatttgtatttttatttatgttttgagacggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtc

SEQ ID NO: 165255 - DNA, 587 bp, Homo sapiens
  Payload ID: 12540
  Gene Symbol: PLCXD1
  Gene Name: phosphatidylinositol-specific phospholipase C, X domain containing 1
  ENST ID: ENST00000430923
  CDS Start-End: 64-587
ggcgggagctgccaggagctctgggattccagcggctggaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatctt

SEQ ID NO: 165256 - DNA, 579 bp, Homo sapiens
  Payload ID: 12540
  Gene Symbol: PLCXD1
  Gene Name: phosphatidylinositol-specific phospholipase C, X domain containing 1
  ENST ID: ENST00000415337
  CDS Start-End: 46-579
accccagttccgtaatatgcaaatgttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatg

SEQ ID NO: 165257 - DNA, 469 bp, Homo sapiens
  Payload ID: 12540
  Gene Symbol: PLCXD1
  Gene Name: phosphatidylinositol-specific phospholipase C, X domain containing 1
  ENST ID: ENST00000429181
  CDS Start-End: 288-469
cttttccagctggctgcagagaaggggccagctccctcctggggacccggagccgcggtacagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacga

SEQ ID NO: 165258 - DNA, 587 bp, Homo sapiens
  Payload ID: 12540
  Gene Symbol: PLCXD1
  Gene Name: phosphatidylinositol-specific phospholipase C, X domain containing 1
  ENST ID: ENST00000447472
  CDS Start-End: 64-587
atatgcaaatgtagggcgccatgatgttccacacgcctgagggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatctt

SEQ ID NO: 165259 - DNA, 284 bp, Homo sapiens
  Payload ID: 12540
  Gene Symbol: PLCXD1
  Gene Name: phosphatidylinositol-specific phospholipase C, X domain containing 1
  ENST ID: ENST00000443019
  CDS Start-End: 61-284
gtggctcacgcctgtaatcccagcaccgcggaggttgcggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctg

SEQ ID NO: 165260 - DNA, 555 bp, Homo sapiens
  Payload ID: 12540
  Gene Symbol: PLCXD1
  Gene Name: phosphatidylinositol-specific phospholipase C, X domain containing 1
  ENST ID: ENST00000445062
  CDS Start-End: 292-555
gaagggaggccgtgcagggggaggggaggccgtgcagggggagggggggccgtgcaggcggagggggccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccag

SEQ ID NO: 165261 - DNA, 828 bp, Homo sapiens
  Payload ID: 12540
  Gene Symbol: PLCXD1
  Gene Name: phosphatidylinositol-specific phospholipase C, X domain containing 1
  ENST ID: ENST00000448477
  CDS Start-End: 455-828
gggctggaccagctaaaggctcgcatttgcatattaaaggttgccaagccgggtctaagagccagggctttcacgctagacaagaaacattttttggagctgcaaaaaatgcttccaaggaccccttttcctctctctctctctcttttttttttttcttttttggatatggagtttcactcttgttgcccagcctggagtgcagtggcgggatctccgctcactgtaacctccacctcccgggttcaagcgattctcctgcctcagcctcccgagtagctgggatgacaggtgccacaggtgcccaccaccacgcccagctaatttttgtatttttagtagagatggggttttgtcaagttggccaggctggtctcgaactcctgacctgaagtcaccgtaaaaaacctcttttcctcttctccttcctcaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgta

SEQ ID NO: 165262 - DNA, 2063 bp, Homo sapiens
  Payload ID: 12541
  Gene Symbol: PLCXD2
  Gene Name: phosphatidylinositol-specific phospholipase C, X domain containing 2
  Uniprot ID: Q0VAA5
  ENST ID: ENST00000393934
  CDS Start-End: 571-1485
gctgggagtcctggtgccgccggctgcacttctgtgtgtctttcaggaagccacagggcagggggcgtctgtgcagagaagcgggggagtgagtagcaggcaggcccagcttgtgtaccagcccagtgacatatatagaaacataaatcaggctagagccggcgcgcccgggcgcgcacctgtgtatggacccgcaggcatgtctgtacactgggtgggcacctgtcttgtgagtggctccgggtgtggctgctcctcggactttcagtttatgtaagatttatctctaggggcctaccttcccccatctccagaggggaacataagaagtttaacggagctgggactgagcagattaagggagtggagcggaggctgggccggagagagtggggactgtgagtgctagtgggtaaggatccatctgtttgccccgtcccccagccagaaaggcattttggaaagactggcgtggcaagcgtcgccctgaaacgtccacagagcccaagaagtgatgatcactgagtgagtggcactgggctgagactggccagtttgttaacaacagggatgctagcagttaggaaggccaggaggaaactcaggatggggaccatctgctcccccaaccccagcgggacaaagacatcatcggaggtctgcaatgccgactggatggcctcgctcccccctcacctccacaacctccccctttccaatctggcaatcccaggctcacatgattcattcagctactgggtggatgaaaagtccccagtggggcctgaccaaacccaagctatcaaacgcctcgccaggatctccttggtgaagaagctaatgaagaagtggtctgtgactcagaacctgacatttcgagaacagctggaagctgggatccgctactttgacctgcgtgtgtcttccaaaccaggggatgccgaccaggagatctacttcatccatgggctttttggcatcaaggtctgggatgggctgatggaaattgactcgtttcttacacagcacccccaggagattatcttcctggatttcaaccacttctatgccatggatgagacccatcacaaatgcctggttctgcggatccaggaggcctttggaaacaagctgtgcccagcctgcagtgtggaaagtttgacgctgcgaactctgtgggagaagaactgccaggttcttattttctaccactgtcccttctacaagcagtaccccttcctgtggccaggaaagaagattccagcgccctgggcaaacaccacaagtgtgcgcaaactaatcctcttcttggagaccactctgagtgagcgggcctcacggggctccttccatgtctcccaagcgatcctcacccccagagtgaagaccattgcccggggcttggttgggggcctcaagaacacgctggttcataggctggcactgatcccagtttatcctttgagattcagcagaagatcctgatggaggaggaggataccaagagagaggtgcccaaggaagatggagttggtgatgtgcaacatttcggtgagaactttattgtcagaggttttcagtacatatttacaagttcttactccatcatacatattgggaatgagctggcattttcaagcatatacccaggagtccagcaatcattggggaagagagcctgaggctggcaatccttgcccagaactttggtcacctgcttgttcacaggccaccatatcttacttcactgaagtcatatgctgaggttttatttagtccagatgctgaaggatgggaagacccaagcagctggtgtggaggtctttcccagtgactcatcagtcattcagaaatcaaagcctgcacaagaaagggtgggatgggatgtatagagaaagacaccaagcctttagactccagcagagtagctgatattgacatatctgaggagggaggaggctccaatacgactactcccaattcacagggtttgtggttctggatgaaatctttgcaaagggtttccctggcactcaaacagaataaataggcttataaagtgt

SEQ ID NO: 165263 - DNA, 529 bp, Homo sapiens
  Payload ID: 12541
  Gene Symbol: PLCXD2
  Gene Name: phosphatidylinositol-specific phospholipase C, X domain containing 2
  ENST ID: ENST00000468174
  CDS Start-End: 311-529
tcctaagtttgcaaatgaagaaacagaattccaagtacaagtttggaagcccaggttcacagaagtaatcacagcagaaccagcactgggattcaggctcagctgtggaattacagactgtttcttcaactgagagaagatggggaaatttaaatgaacctaagccacatggcttgaccacagatagaagctctctctcaaaggctcacatgattcattcagctactgggtggatgaaaagtccccagtggggcctgaccaaacccaagctatcaaacgcctcgccaggatctccttggtgaagaagctaatgaagaagtggtctgtgactcagaacctgacatttcgagaacagctggaagctgggatccgctactttgacctgcgtgtgtcttccaaaccaggggatgccgaccaggagatctacttcatccatgggctttttggcatcaaggtctgggatgggctgatggaaattgactcgtttcttacacagcacccccaggagattatcttcctggatttcaac

SEQ ID NO: 165264 - DNA, 1721 bp, Homo sapiens
  Payload ID: 12541
  Gene Symbol: PLCXD2
  Gene Name: phosphatidylinositol-specific phospholipase C, X domain containing 2
  Uniprot ID: Q0VAA5
  ENST ID: ENST00000477665
  CDS Start-End: 325-1242
tggctgctcctcggactttcagtttatgtaagatttatctctaggggcctaccttcccccatctccagaggggaacataagaagtttaacggagctgggactgagcagattaagggagtggagcggaggctgggccggagagagtggggactgtgagtgctagtgggtaaggatccatctgtttgccccgtcccccagccagaaaggcattttggaaagactggcgtggcaagcgtcgccctgaaacgtccacagagcccaagaagtgatgatcactgagtgagtggcactgggctgagactggccagtttgttaacaacagggatgctagcagttaggaaggccaggaggaaactcaggatggggaccatctgctcccccaaccccagcgggacaaagacatcatcggaggtctgcaatgccgactggatggcctcgctcccccctcacctccacaacctccccctttccaatctggcaatcccaggctcacatgattcattcagctactgggtggatgaaaagtccccagtggggcctgaccaaacccaagctatcaaacgcctcgccaggatctccttggtgaagaagctaatgaagaagtggtctgtgactcagaacctgacatttcgagaacagctggaagctgggatccgctactttgacctgcgtgtgtcttccaaaccaggggatgccgaccaggagatctacttcatccatgggctttttggcatcaaggtctgggatgggctgatggaaattgactcgtttcttacacagcacccccaggagattatcttcctggatttcaaccacttctatgccatggatgagacccatcacaaatgcctggttctgcggatccaggaggcctttggaaacaagctgtgcccagcctgcagtgtggaaagtttgacgctgcgaactctgtgggagaagaactgccaggttcttattttctaccactgtcccttctacaagcagtaccccttcctgtggccaggaaagaagattccagcgccctgggcaaacaccacaagtgtgcgcaaactaatcctcttcttggagaccactctgagtgagcgggcctcacggggctccttccatgtctcccaagcgatcctcacccccagagtgaagaccattgcccggggcttggttgggggcctcaagaacacgctggttcatagcaatcgctggaacagccatgggccatccctgctgagtcaggaaagaagctgagggaagagtcgggattgaaaagcagcagacaaggctggcactgatcccagtttatcctttgagattcagcagaagatcctgatggaggaggaggataccaagagagaggtgcccaaggaagatggagttggtgatgtgcaacatttcggtgagaactttattgtcagaggttttcagtacatatttacaagttcttactccatcatacatattgggaatgagctggcattttcaagcatatacccaggagtccagcaatcattggggaagagagcctgaggctggcaatccttgcccagaactttggtcacctgcttgttcacaggccaccatatcttacttcactgaagtcatatgctgaggttttatttagtccagatgctgaaggatgggaagacccaagcagctggtgtggaggtctttcccagtgactcatcagtcattcagaaatcaaagcctgcacaagaaagggtgggatg

SEQ ID NO: 165265 - DNA, 7538 bp, Homo sapiens
  Payload ID: 12542
  Gene Symbol: PLCXD3
  Gene Name: phosphatidylinositol-specific phospholipase C, X domain containing 3
  Uniprot ID: Q63HM9
  ENST ID: ENST00000328457
  CDS Start-End: 103-1068
gtaaactctagcggggctagagcaaacattggattagcggcagcagcctgccagcctgcccgaggagtgctgggaccagcgcgctgcacgccgactggcacgatggcctcgtctcaggggaaaaacgagctgaaattagccgactggatggcaactctgccggagagcatgcacagcatccccctcaccaatttagccattccagggtctcatgattccttcagcttctacattgatgaagcctctccagtaggtcctgagcagccagaaactgtccagaattttgtctctgtgtttggaactgtggccaaaaagctcatgcggaaatggttagccactcagacaatgaattttactggccagctaggagctggaattcgttattttgatcttcgaatttccaccaagcccagagaccccgacaatgaactctattttgctcatggtttgttcagtgccaaagtcaatgaaggccttgaggagatcaatgcattcctcacagatcaccataaggaggtagtgttcttggacttcaaccacttttatgggatgcagaaatatcaccatgaaaaactggtccaaatgctgaaagacatctatggaaataaaatgtgcccagcgatttttgcccaggaagttagtttaaagtacctgtgggagaaggactatcaagtgctggtcttctaccatagtccagtggctctggaagtgccctttctctggcctgggcagatgatgccagcaccctgggccaacaccacagaccccgagaaactgatccagtttcttcaagcatccatcactgagagaagaaagaagggatcgttttttatatctcaggtggtgctgacccccaaagctagcactgtggtcaaaggggtggcaagtggcctcagagaaacaatcacagaaagagctcttcctgccatgatgcagtgggtccgcacgcagaagccaggagagagtggcatcaatattgtcactgccgattttgtagaacttggtgactttatcagcactgtcataaagctcaactatgtctttgatgaaggagaagccaacacttgatagcactacttggagtttccatgaataagatggagaaagctcattgtattagggcatactatctgtaaacactctgatcttcctattccactgagtctctgaagggaatagggctggtagtgggtgggaaaaggggaaaaactgtttcttcagtgattacaatcatactcttcattactataaatatttcatttcccatttgatgagcaaaatctacttctagtgttaggaataaaaaaaaaagaccagtaactttgtttttcaaaattagtctttgtaacatagaattcatgagtgtttacttgattaggttctctatttccagcctatgactcctacgctgtctataccctgcaacctttctgctccctctcttgctcgctctttttaatcagatgctgtatgggaatcaaaacaattgaatgcccaacattttgtgtattacattgttgtcttaaaacttactagttttgtgggacttgttataatgctctatagtcatccacagttgggcaatcatagctaatttttggtcatagaaaatctgcatcaaatcagtttccatgcatcagtaatattgaaggtcataatcagtgatttttgttatatgaaaataatagtgtttcacagtatttctatttaaggcagctataaatataggagaaaaatgtttttggagagctgtgaatgccaatttcagagggaaaaatggttgaggggtgaaagagatgtatggcattttaatttggcaatctcttaaataatattgccctgcaagtacccagtaaatggtaaggtacaagtgtgttaaaattgaaaactctgaaaataactctttaaaaagccctcttaatgatgctcttgatgaaagaaaaagacagaaggaaggaagaagaaaaagactgcaagctttcctgccaatttgggattttcaaatatttaattctaaattccagattttaaggaagatttttcaagaaactgcaagtttttgacttgaaggaaagaaagaggaaggctggtagaagcagttagagcaatgtgtttgaaattatgtccatgaaatcacagggatctctgaaatatctttaggaaacttgaaatttatgaggtctgaatggacttgtttaaaattggctctgactcctcacttctgagtttcatcctatccgagggatgagattaaggcagaggcaaaagtttcacacaaagtttctgcaacctaacgtttaatagtccgggtctacagggaagaacaatgacacagcttgagcgttacttcctccttcgtgtcattgtgatatttgacaactctaaaaaataaaaaaaaaaaacttagagcacaataatccttgcctatgtacttcacaggaatattgtgaggtgtttataaaattataaaatttgatgaaattcttacaattattaattattttattttcatgtttagaaataatcacaccccaatagtttcctaggataatacagtccatgcaaagtagggtcatagagaaataaaagcatgccctcagcttttaatgaacttaaatgtagcacatatggcttaatctcttagacttagataagggagttcaattcaaaaccatatatgtcaagaccacaaataatcaagagttgatttcaagattataaatactcatgatcagaaaatagtacttattagcaattaaagggaggaaaagaaattgtttatactgaagagaatgtttatgaggagtgtgtatgtacctgtggtataccaaatagcatacatgtacacacaaaaatgtgtgtatacatttgggttgtgtgtatacatcttgccatatacaatatacaaacatatgcccattcctgtgatagcatacaaattcaaacatacagaaacacacacagatatggacacagtacaattcttcttttcaaatgaagacattgataatattaaataatttaattttaagactgaaacccttaatattgtgtgaaaaagagtaataaaacctttgaaagtagagtagatgatcacatcaaagtatttttgtaaaagaattctagtgtaggacttaattatttttaaaatatatttcttctcttctttccattttcccttcccttgtagttttattatctttctgtcttttacacctgctctttatgtgaaaatgtatatgaatccttttaaaatgattaggattattgaaatgtatgtcccgtaaatttggtttttgggcagactttctctctaactggctattcattcatccttcaggaggatcttagccaagaatatttgcaatgacacatgaatttaattttataaatataatggaaaacagatttttcatcatatcatgaataaaatatagaggtaactatgttgtattttcttgaacctagatactttctcatagtgtttgcttagaattaactttgtcctatttgtcaactgggttctggaaaaaaacaaacatgatgaagcttttgaataattgtgcagttttttaactagggaaagctttgtactgctgctaatgatatgcacccagaaaccttgttagacaaaaggcagtttcaagccaatgctatggtttccatgtggacatacagtgcctatgtagcaggcacttagagtaaatggacttgccttaatttataaaggagggaagaggtagaagggaaccatgggtcctccagctagagggggagtttactaaaagggagtccttggaaaggggaatggagagaaggtgcctttgactgtcttctatccattagttctgccctggagcacactggggaagcaggctgcgggccttccaaaagtaaaaaatggtgatatgcaatcgaagcttatccttagcctatgcacatttgtctcagctgggcattgtcttttcagagagcttgtagcacaagggctacacatgggcgccaagatggtggtagatacaccttggtgcactttttgttttacttgtttcttaagactatttcacaagtcctgtgaggcaaaaaaacaaaacaaaacaaaacaaccaaacaaatacaatctaacttttacccaatctacagcaggaaatcaaaggagtgggtggaatgagagaaaatatgcaaagagatcatttttaagtttgatttcctgtctgtaattttcaaggactaatatagcaaatttttcttctgccattatcatttatgtctccctatttaccacacaataatgtaaatgcagagaatgaggaggcatcttttaaaagccttaggatattctatatgatgacctcaatattgactttcagccatactgggaaaacttacttttcatggagtgccacctaacagtgaatgtattagagtataaaatgtttgccatgtatacacctgtatgtgcacatacacacattacacacacacacagaatgcacatttcacacacatatacttattattcaagttgaaactgcactctaatcaatctgagtctattgctgtttcaactcttaaaatcaatatctcctacattagtagatataaacataattcaaatatttaaatatttaagaggagaaaagtaactagaaaaccaatgaaaagtgaggccatcagaaatagaaaatgcctggcacgaacagtctatctaaattctcaatttcacttcaaattagagaatccataatggactagaatataaattacaaacacatacacacatcttcacttaaagttgttttaagttctttgaagttctgacatgtttttagccagggttatttgttcaggttcttccttgttaggattccagactggaaagttggaagtctcaggaaatgcatgtttccatgagttttttagtttcacagttttacagatccaacgacacaatcttttaatctttggtcactcaaccaaacaggagttccgtaggcagagtgctcactttgaattgctaatagaaaataatgcacagtgtcctcaggatatgctaaacaaggtttttaagagcattttattttacagcactttagtcttttcagctagatttcagtgacactatggtgtaaatgctatatctgccataacttattggtggctcctgtgttacatacagttttaaataatgctctaaattgtttgttttcccaatgataatgataaagtgttctgtagaatttgtaaaacatgtcaattgaatctgttgaaaattgtgtaattgttatttcaattgtgatactattttgtaggtaatagttttaaacgtatatttgtatgagtcaaaagtatgtgcttgtatgtggtatgtgtgtgtaagtatataatatcttatcaaaaatcaaacttatcctaaagaaaaagggcacattgtgaccagccttaatttattaacacttttttgttgtttttgcaatttggatttaaaattgaaacagaaattaagtttttgttaaaaatggtgtcttttaattttgtgaggaatgggctttagaacctatctgagttcccacaagcaaactgtccaccttgtgaggtaccccattgcttttcgtaataatcaaacatcaattcatatattaacttcattttcatacagactaatttgttttcatcaacaatagaaccagtacacctttaaagttgaccttcccaacatggcacccatttttctttaatgataaattttccatgaaaaattgtttctccaaaccattactttttaaaattcaatcttcccaagtaagatgaactgccttggtgttaggagagcttttaaaggcccatccatactaggtggttccaacatggttctcttctcgagaaaacaagcatgcaacccacacacttttctggtctgccccacgtgtagaattagtctagcaatagaaaactcatgactgacaaggatctacacatgtggtcatgcttgaagcaaaaattctgtgaccttctttgggcttggatctgattacagaatattaattaactttcttatttcctttctttctccatccttagttattccttttcaatatttagagttgccaggtaaaatacaggatatccagtgaaatttaaatttcagataaacagtatttctttagcatatttctcatatatttaatcagacatactttcactttaaaaaaagtttatctgaaattcaaatgtaactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgctttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtacc

SEQ ID NO: 165266 - DNA, 7704 bp, Homo sapiens
  Payload ID: 12542
  Gene Symbol: PLCXD3
  Gene Name: phosphatidylinositol-specific phospholipase C, X domain containing 3
  Uniprot ID: Q63HM9
  ENST ID: ENST00000377801
  CDS Start-End: 76-1041
attggattagcggcagcagcctgccagcctgcccgaggagtgctgggaccagcgcgctgcacgccgactggcacgatggcctcgtctcaggggaaaaacgagctgaaattagccgactggatggcaactctgccggagagcatgcacagcatccccctcaccaatttagccattccagggtctcatgattccttcagcttctacattgatgaagcctctccagtaggtcctgagcagccagaaactgtccagaattttgtctctgtgtttggaactgtggccaaaaagctcatgcggaaatggttagccactcagacaatgaattttactggccagctaggagctggaattcgttattttgatcttcgaatttccaccaagcccagagaccccgacaatgaactctattttgctcatggtttgttcagtgccaaagtcaatgaaggccttgaggagatcaatgcattcctcacagatcaccataaggaggtagtgttcttggacttcaaccacttttatgggatgcagaaatatcaccatgaaaaactggtccaaatgctgaaagacatctatggaaataaaatgtgcccagcgatttttgcccaggaagttagtttaaagtacctgtgggagaaggactatcaagtgctggtcttctaccatagtccagtggctctggaagtgccctttctctggcctgggcagatgatgccagcaccctgggccaacaccacagaccccgagaaactgatccagtttcttcaagcatccatcactgagagaagaaagaagggatcgttttttatatctcaggtggtgctgacccccaaagctagcactgtggtcaaaggggtggcaagtggcctcagagaaacaatcacagaaagagctcttcctgccatgatgcagtgggtccgcacgcagaagccaggagagagtggcatcaatattgtcactgccgattttgtagaacttggtgactttatcagcactgtcataaagctcaactatgtctttgatgaaggagaagccaacacttgatagcactacttggagtttccatgaataagatggagaaagctcattgtattagggcatactatctgtaaacactctgatcttcctattccactgagtctctgaagggaatagggctggtagtgggtgggaaaaggggaaaaactgtttcttcagtgattacaatcatactcttcattactataaatatttcatttcccatttgatgagcaaaatctacttctagtgttaggaataaaaaaaaaagaccagtaactttgtttttcaaaattagtctttgtaacatagaattcatgagtgtttacttgattaggttctctatttccagcctatgactcctacgctgtctataccctgcaacctttctgctccctctcttgctcgctctttttaatcagatgctgtatgggaatcaaaacaattgaatgcccaacattttgtgtattacattgttgtcttaaaacttactagttttgtgggacttgttataatgctctatagtcatccacagttgggcaatcatagctaatttttggtcatagaaaatctgcatcaaatcagtttccatgcatcagtaatattgaaggtcataatcagtgatttttgttatatgaaaataatagtgtttcacagtatttctatttaaggcagctataaatataggagaaaaatgtttttggagagctgtgaatgccaatttcagagggaaaaatggttgaggggtgaaagagatgtatggcattttaatttggcaatctcttaaataatattgccctgcaagtacccagtaaatggtaaggtacaagtgtgttaaaattgaaaactctgaaaataactctttaaaaagccctcttaatgatgctcttgatgaaagaaaaagacagaaggaaggaaggaaggaaggaaggaaggaaggaaggaaggaaggaaggaaaggaagaaaggaagggagggaggaagggagggaagaagggagggaaggacagaaggaaggacgggaggaaggaaggaagggaggaaggaaggaaggaagagagggagggagggaggaagagagggagggagggaggaagagaggaaggaagaagaaaaagactgcaagctttcctgccaatttgggattttcaaatatttaattctaaattccagattttaaggaagatttttcaagaaactgcaagtttttgacttgaaggaaagaaagaggaaggctggtagaagcagttagagcaatgtgtttgaaattatgtccatgaaatcacagggatctctgaaatatctttaggaaacttgaaatttatgaggtctgaatggacttgtttaaaattggctctgactcctcacttctgagtttcatcctatccgagggatgagattaaggcagaggcaaaagtttcacacaaagtttctgcaacctaacgtttaatagtccgggtctacagggaagaacaatgacacagcttgagcgttacttcctccttcgtgtcattgtgatatttgacaactctaaaaaataaaaaaaaaaaacttagagcacaataatccttgcctatgtacttcacaggaatattgtgaggtgtttataaaattataaaatttgatgaaattcttacaattattaattattttattttcatgtttagaaataatcacaccccaatagtttcctaggataatacagtccatgcaaagtagggtcatagagaaataaaagcatgccctcagcttttaatgaacttaaatgtagcacatatggcttaatctcttagacttagataagggagttcaattcaaaaccatatatgtcaagaccacaaataatcaagagttgatttcaagattataaatactcatgatcagaaaatagtacttattagcaattaaagggaggaaaagaaattgtttatactgaagagaatgtttatgaggagtgtgtatgtacctgtggtataccaaatagcatacatgtacacacaaaaatgtgtgtatacatttgggttgtgtgtatacatcttgccatatacaatatacaaacatatgcccattcctgtgatagcatacaaattcaaacatacagaaacacacacagatatggacacagtacaattcttcttttcaaatgaagacattgataatattaaataatttaattttaagactgaaacccttaatattgtgtgaaaaagagtaataaaacctttgaaagtagagtagatgatcacatcaaagtatttttgtaaaagaattctagtgtaggacttaattatttttaaaatatatttcttctcttctttccattttcccttcccttgtagttttattatctttctgtcttttacacctgctctttatgtgaaaatgtatatgaatccttttaaaatgattaggattattgaaatgtatgtcccgtaaatttggtttttgggcagactttctctctaactggctattcattcatccttcaggaggatcttagccaagaatatttgcaatgacacatgaatttaattttataaatataatggaaaacagatttttcatcatatcatgaataaaatatagaggtaactatgttgtattttcttgaacctagatactttctcatagtgtttgcttagaattaactttgtcctatttgtcaactgggttctggaaaaaaacaaacatgatgaagcttttgaataattgtgcagttttttaactagggaaagctttgtactgctgctaatgatatgcacccagaaaccttgttagacaaaaggcagtttcaagccaatgctatggtttccatgtggacatacagtgcctatgtagcaggcacttagagtaaatggacttgccttaatttataaaggagggaagaggtagaagggaaccatgggtcctccagctagagggggagtttactaaaagggagtccttggaaaggggaatggagagaaggtgcctttgactgtcttctatccattagttctgccctggagcacactggggaagcaggctgcgggccttccaaaagtaaaaaatggtgatatgcaatcgaagcttatccttagcctatgcacatttgtctcagctgggcattgtcttttcagagagcttgtagcacaagggctacacatgggcgccaagatggtggtagatacaccttggtgcactttttgttttacttgtttcttaagactatttcacaagtcctgtgaggcaaaaaaacaaaacaaaacaaaacaaccaaacaaatacaatctaacttttacccaatctacagcaggaaatcaaaggagtgggtggaatgagagaaaatatgcaaagagatcatttttaagtttgatttcctgtctgtaattttcaaggactaatatagcaaatttttcttctgccattatcatttatgtctccctatttaccacacaataatgtaaatgcagagaatgaggaggcatcttttaaaagccttaggatattctatatgatgacctcaatattgactttcagccatactgggaaaacttacttttcatggagtgccacctaacagtgaatgtattagagtataaaatgtttgccatgtatacacctgtatgtgcacatacacacattacacacacacacagaatgcacatttcacacacatatacttattattcaagttgaaactgcactctaatcaatctgagtctattgctgtttcaactcttaaaatcaatatctcctacattagtagatataaacataattcaaatatttaaatatttaagaggagaaaagtaactagaaaaccaatgaaaagtgaggccatcagaaatagaaaatgcctggcacgaacagtctatctaaattctcaatttcacttcaaattagagaatccataatggactagaatataaattacaaacacatacacacatcttcacttaaagttgttttaagttctttgaagttctgacatgtttttagccagggttatttgttcaggttcttccttgttaggattccagactggaaagttggaagtctcaggaaatgcatgtttccatgagttttttagtttcacagttttacagatccaacgacacaatcttttaatctttggtcactcaaccaaacaggagttccgtaggcagagtgctcactttgaattgctaatagaaaataatgcacagtgtcctcaggatatgctaaacaaggtttttaagagcattttattttacagcactttagtcttttcagctagatttcagtgacactatggtgtaaatgctatatctgccataacttattggtggctcctgtgttacatacagttttaaataatgctctaaattgtttgttttcccaatgataatgataaagtgttctgtagaatttgtaaaacatgtcaattgaatctgttgaaaattgtgtaattgttatttcaattgtgatactattttgtaggtaatagttttaaacgtatatttgtatgagtcaaaagtatgtgcttgtatgtggtatgtgtgtgtaagtatataatatcttatcaaaaatcaaacttatcctaaagaaaaagggcacattgtgaccagccttaatttattaacacttttttgttgtttttgcaatttggatttaaaattgaaacagaaattaagtttttgttaaaaatggtgtcttttaattttgtgaggaatgggctttagaacctatctgagttcccacaagcaaactgtccaccttgtgaggtaccccattgcttttcgtaataatcaaacatcaattcatatattaacttcattttcatacagactaatttgttttcatcaacaatagaaccagtacacctttaaagttgaccttcccaacatggcacccatttttctttaatgataaattttccatgaaaaattgtttctccaaaccattactttttaaaattcaatcttcccaagtaagatgaactgccttggtgttaggagagcttttaaaggcccatccatactaggtggttccaacatggttctcttctcgagaaaacaagcatgcaacccacacacttttctggtctgccccacgtgtagaattagtctagcaatagaaaactcatgactgacaaggatctacacatgtggtcatgcttgaagcaaaaattctgtgaccttctttgggcttggatctgattacagaatattaattaactttcttatttcctttctttctccatccttagttattccttttcaatatttagagttgccaggtaaaatacaggatatccagtgaaatttaaatttcagataaacagtatttctttagcatatttctcatatatttaatcagacatactttcactttaaaaaaagtttatctgaaattcaaatgtaactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgctttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtaccaat

SEQ ID NO: 165267 - DNA, 2655 bp, Homo sapiens
  Payload ID: 12543
  Gene Symbol: PISD
  Gene Name: phosphatidylserine decarboxylase
  Uniprot ID: Q9UG56
  ENST ID: ENST00000266095
  CDS Start-End: 431-1558
ggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttg

SEQ ID NO: 165268 - DNA, 2669 bp, Homo sapiens
  Payload ID: 12543
  Gene Symbol: PISD
  Gene Name: phosphatidylserine decarboxylase
  Uniprot ID: Q9UG56
  ENST ID: ENST00000382151
  CDS Start-End: 421-1548
ccatcctgcagctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 165269 - DNA, 2194 bp, Homo sapiens
  Payload ID: 12543
  Gene Symbol: PISD
  Gene Name: phosphatidylserine decarboxylase
  ENST ID: ENST00000397500
  CDS Start-End: 230-1018
ggagcccggaagctggagccacctgcggccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagag

SEQ ID NO: 165270 - DNA, 1963 bp, Homo sapiens
  Payload ID: 12543
  Gene Symbol: PISD
  Gene Name: phosphatidylserine decarboxylase
  Uniprot ID: Q9UG56
  ENST ID: ENST00000439502
  CDS Start-End: 225-1454
ctgcgaccaagcccaggtttagcgaaacctacagctccactagttcccctacctccgcaggtgccaagcgggttaggtggggagtagccacagggcggagcttagtcggctccgcccccaacccgcgcttttctcattggcccactgaactcgagactcgtgacgccttaagcgtgcgcccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgtt

SEQ ID NO: 165271 - DNA, 609 bp, Homo sapiens
  Payload ID: 12543
  Gene Symbol: PISD
  Gene Name: phosphatidylserine decarboxylase
  ENST ID: ENST00000429683
  CDS Start-End: 391-609
ccttcatccccccttcctcgcccctccacagacccagggcatttggtggacacttttgcttgcagttaggtcaagtggaggtatggaagaacatggaaatccatggaggaggaccctatctgtcttcttccccctgccgcatcccagggctgtggcttgtcatgtggcacttgcttgggctggatccagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagg

SEQ ID NO: 165272 - DNA, 2264 bp, Homo sapiens
  Payload ID: 12543
  Gene Symbol: PISD
  Gene Name: phosphatidylserine decarboxylase
  ENST ID: ENST00000437808
  CDS Start-End: 14-184
aggagcagacaagatggcgacgtccgtggggcaccgatgtctgggattactgcacggggtcgcgccgtggcggagcagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaat

SEQ ID NO: 165273 - DNA, 722 bp, Homo sapiens
  Payload ID: 12543
  Gene Symbol: PISD
  Gene Name: phosphatidylserine decarboxylase
  ENST ID: ENST00000442379
  CDS Start-End: 480-722
aagtggggcctgaaagccctggcagcagtggctggtcccctccctgtcatggcttactggaccgggcagccctagggccttgccccctactgcctccccaggccagctgaggaagaggatgagcagtgcaggctggctcagccctgggtagcagggacagagcaggtggccaggactggggacagtgggctttagtgcaggggcttttgcactggactgcaagccctgagcaggtgacctgagcaggtgtgtgaccagtgcctgtctgtctgcaatagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgcca

SEQ ID NO: 165274 - DNA, 460 bp, Homo sapiens
  Payload ID: 12543
  Gene Symbol: PISD
  Gene Name: phosphatidylserine decarboxylase
  ENST ID: ENST00000431201
  CDS Start-End: 242-460
atttggtggacacttttgcttgcagttaggtcaagtggagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagg

SEQ ID NO: 165275 - DNA, 1015 bp, Homo sapiens
  Payload ID: 12543
  Gene Symbol: PISD
  Gene Name: phosphatidylserine decarboxylase
  ENST ID: ENST00000422020
  CDS Start-End: 332-1015
gggccggtcactccgcgcaagtttgggttcctgttttagaactgccacctaagcccctcttatttcatctttcctgtggtggaaacccctgcccccaccggagtgtgaggttgactttttggaaagagagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggac

SEQ ID NO: 165276 - DNA, 1723 bp, Homo sapiens
  Payload ID: 12543
  Gene Symbol: PISD
  Gene Name: phosphatidylserine decarboxylase
  ENST ID: ENST00000435900
  CDS Start-End: 1-1088
tgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagaccttt

SEQ ID NO: 165277 - DNA, 2366 bp, Homo sapiens
  Payload ID: 12544
  Gene Symbol: PTDSS1
  Gene Name: phosphatidylserine synthase 1
  ENST ID: ENST00000337004
  CDS Start-End: 129-455
cagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagcctatcaaa

SEQ ID NO: 165278 - DNA, 5177 bp, Homo sapiens
  Payload ID: 12544
  Gene Symbol: PTDSS1
  Gene Name: phosphatidylserine synthase 1
  Uniprot ID: P48651
  ENST ID: ENST00000517309
  CDS Start-End: 327-1748
agccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagcctatcaaaggtctgtctgtaaaatgctcattttcttgcatcttactggtatcttctattgattgtaagcagtctgtgtttttcaagtgactttaggataatatatatgtgttttacatagtgagaagaaaaaagaaaagatgtgtattttaaagggcttacagacatatatgtcctacttcttagactacccaagtgaccaacaggaatgaacaacatagtcattgttttttcctgtggtaatggtttccaagttggacttttttttcctctaacaagaggccagtacccagttgattagcttacagatatcaactcactgaaagtaatcttttgttccctcatttcacacagcacaaaggttcgttctgatgtttcttcttctttaaggaaatctttagccatagaagtgtcactttttttttttctgcaaaagaattccaagatgaacgggttgaatgaatcatgccagccagggtcacatcctgtcctcagggggcccagtgctcaatagtagattctgcgggagtggagaagcgtcagtggcagctccgctcacttggtgagtgagggatttggctgtgatgagcctcagctccgagctctcaaatgtcctccagccagcatctgcctgcttcccacaaaaggatagaagagaggcaaagtgcgtgtttcataaaacctgcctgcacttttataacccatcaaagaggccatttttaaacacaggtacaatttaaacatgatctttctttgcaaataaatatgttttgtttcatcctgtgttctgcttttctaagcatgacatacttgtgcccattggagaagacacctgtctcttctttctcacaccggtggtgcctcactgagtgtttccgggttcattttccgggagcactgggcctgacactttcacactcttctgactttcgccttgttgcaactgatggagcatgtgtgcttcctctgaggccagcctacaggaggcagctgtttcgcaggtggtgaattcgactttactgtggcattgtgaagagcagggtgcacaggagatgattttttctccatggctttgtaagaaacagccaggaaagttctcagatactttccatgccctttctttgagttgaaactttctatttcccttcagtcagagctctttactatagtagttacaaaaccagtgctttccatggctggccagaaccacagctgctattccttttagaagccatactgctgggtttggcctacttttttcaccgtttctatggaaataaacctcacattgatggaaatagaatgcgtgtttcagaatcatcattcaatatctgaaatgatttgattgtaaattatctcatggtccctgtttgcaaaccaccctcttaagagagaacattgttttggacctaaagcttgaagaacggtttatgtatttttctccttaagtagcattgcattgagtgttaggttcttttccctttttttcattcttggtcttcccaaagcttcttcccacatttcgtttgtgtctgtttccaccattcatagaaaccttggaaccactctcacagcaatgctaggatgtttcatggacctgttaagcattttgatgatacaagacatcctatcaatgccagtcttattttcgctaggactctgcttccacagtaagctcctaaggtgctcacccaacccaggagaaaacaaaattcattaccaaatacaacaggttcagccttcttggtcttccctcagaagccaccgtgtagcaccctggaatgatgcctctttatgccaaggcccaccctttggaattgggagggttttgggtagaatcctgcacttacagaggcccttggggtcattgagaagtggaggaggttggacacagaaggggaggctaaacacaaggtggggaagaaaaaatgtaaccattggcagccagactgaagctagccctttaaaatacggggttggggggttaacatccgctctttggaatgtgctcagtgactgctgcagagttcctgggccaccctaatgtttaccaggtgggcgttgtttatatggttcttattgttatgacaactagaaatcccacagtagactagacagtgctccctaccatttcccatttataggattgaaatcaagatgtaaggagagctggccgggcgcagggctcacgcctgtaatcccagcactttgggaggctgaggtgggtggatcgcctgaggtcaggagtttgagaccagcctgaccaatatggtgaaaccctgtctctgctgaaaatacttaaattagccgggcatggtggcaggcacctgtagtcccagctactcgggagacagagacagaagaaatgcttgaacccaggaggtggaggttccagtgagccgagatcacgccaccgcactctctaacctgggcgacagagcgagactatctc

SEQ ID NO: 165279 - DNA, 1112 bp, Homo sapiens
  Payload ID: 12544
  Gene Symbol: PTDSS1
  Gene Name: phosphatidylserine synthase 1
  Uniprot ID: P48651
  ENST ID: ENST00000522072
  CDS Start-End: 75-980
aggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatg

SEQ ID NO: 165280 - DNA, 2445 bp, Homo sapiens
  Payload ID: 12545
  Gene Symbol: PTDSS2
  Gene Name: phosphatidylserine synthase 2
  Uniprot ID: Q9BVG9
  ENST ID: ENST00000308020
  CDS Start-End: 177-1640
caatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttcca

SEQ ID NO: 165281 - DNA, 520 bp, Homo sapiens
  Payload ID: 12545
  Gene Symbol: PTDSS2
  Gene Name: phosphatidylserine synthase 2
  ENST ID: ENST00000527479
  CDS Start-End: 6-188
acgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctgacaggctccaggtgccgctcctactcccgacagctgcgaccctgggctggccctttgccgatgctcctctgtgagaaggatcaagccgtcgacctgaaagcaggcttcgtgagaggagggtttggctcttcttgactgcaaggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttact

SEQ ID NO: 165282 - DNA, 890 bp, Homo sapiens
  Payload ID: 12545
  Gene Symbol: PTDSS2
  Gene Name: phosphatidylserine synthase 2
  ENST ID: ENST00000531520
  CDS Start-End: 161-406
ctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctgctgcgaccctgggctggccctttgccgatgctcctctgtgagaaggatcaagccgtcgacctgaaagcaggcttcgtgagaggagggtttggctcttcttgactgcaaggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaag

SEQ ID NO: 165283 - DNA, 1985 bp, Homo sapiens
  Payload ID: 12545
  Gene Symbol: PTDSS2
  Gene Name: phosphatidylserine synthase 2
  ENST ID: ENST00000633628
  CDS Start-End: 1-1180
aggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttcca

SEQ ID NO: 165284 - DNA, 8233 bp, Homo sapiens
  Payload ID: 12546
  Gene Symbol: PDE10A
  Gene Name: phosphodiesterase 10A
  Uniprot ID: Q9Y233
  ENST ID: ENST00000366882
  CDS Start-End: 156-2495
ccaggcggcggcggccaaactccgcggcgtccccagggcgccagcttcgccctcgccgccgcggccgcgctgctcttcggctccgacatggaagatggaccttctaataatgcgagctgcttccgaaggctgaccgagtgcttcctgagccccaaatgaggatagaagagaggaaatcccaacatttaacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccccattctcccattctttaagaacaatgatttttcttgatggaaaatgcatatcacttgacagttgacaagaaagtgtcatttttgtgttagtgtatcatataattgaatttgaacaagatacatatttttctgcatacaaatttatgaagctggagtctaccaaacacagctttagtcacaaaagttagtttagttatctcatttcgcttggagatggaatttcaggaagggatatattatttaagattattgtttaattacaagaattttaaaagaatgtatgaattctgttttttaatatagaaaataattatggagttaggaatctcatggctacatttacatttttaggttattacagaaaattctcttaatttattatagtcaagtgtattatgtaatctctatttagaacagtttcccaaaggaatgtgattggatttactggttggttaatttcttgtgaaatattgtcataatagaagcacagcttgaacaaaagactgaattctgatataaactgtcaatattgcttttaccatgtgtaagatttacttagtaatcacagatttacctaaaataaaaggacccgggttgcagtgatatttagttaatgatttgttttggaaaacatgcagttaggagtatttttgtattttgtcagatgtttaggagacagactttcgggtcatgtttcttgtcttgttcccagatcttttcttaaaagaacagtgtgacaccagaagccaagagatggtttttactaacaacagctttgatgagttcctattaaggtcgtattgtgtattgtgccaaattttccacccagtataaatttagtaacccgctatgagcatatgtaggatattcaatttgcagatacttttgttggttatgttggtttataatagacaagttttatggtcatatgcaattattccattatctttttggacacagtgaatatgttttttagctaaaaatgtccttggaaacataaatgcctgccaataacatggaatattgaattcgggcaatgtgaattgattaattagaaaagggtcaaaagaaatacaatggatgtggaaactaattctaaaaaatagccctattaatagggcagagactctggtccatttcccagctgtacttctctctaagaggtgtatgaaaaacccatcttgcaaaagagaccaaaatattagacacaatcgttcccattcctgactcttcaatggaaaaggaaggtacagatgtttacagtggtgccccaggtgactcgttctcaccacaacaaaagcaactaattggaaactagatgtgttcaataatagatttcctcttttttggcatgctttttagattttttttcattttgtaaaatctcagttaatttttctttattggtatatttgtgtatgcgagacaaatcctgtattgtacaggatataaatagatgcataaatccttagatacctgggttttttaataggtttaggtttgggtattgtgtttctggtcttttaactcaaaattaaggtttgagctttaataggactaaattattcacctgccttggcctgtgcctttattttaaatactgcaattttacttcttcattcatgtatttattattttgcttttcttgcttaagtataattgaaaatatttgcaggaacgcacaattcattttatcaagttgaatgaataggaccattctctcctcatcagatttctgttctttatttgacttcattgacatataccctggtgactataaccagtgaactgttcagagtcagtcttttcggcaagaacttcagagaactgtgacactggttatgatgtgattttggggggtttcaggtacctaagcatgatttttaaaatcacttctctctttacatatttcgaacatatgtttgctttctacactttgcagattttatttaggatttaattctttaaagactatattcatttagtcactatagtggatctcttctactgcaagtattcatctgatttttaaattatgtaaaatgtaaatcagccaagtatgtcatccgttatagtttccccatgctttcagcgcatggccatgagatttttacatgtgcataagtatttagccaatacacattttgctgacttctttaaccatttatattgtttaaattagtaatatccaatgcagtgcacacttttttgtcttttttccaacggaatattttggttgtctgtagcgttggaagcattttatatgataaaaatagcaagaaaaaattaaaaagtgtcaacggtgtgctggttctaaattaagaagatagaacaaagagaaagacattaatgttacctaagaaacacatttaacatccgaagaagcaatgctgtcctcacttgatgtttctcttctcaacccagcaatggagagcagggcttgcaaagccgtacagagcctacgtgctctttcctgcaagtgggagaaaactaatcaatggcacacagggccaggtgtggccctgtgaggcaaaggataatgtcacctcaggaccaaggtggaaacttacagctgaatccagggcttactaagtagggaagtcagtttacatatttcagttttcctctgatgtttttgaggtactgtgtatttgcagaagtttaagcagaagggttttgtttctattgtaagttaggttctaaaagtgtataatctgatactctagcccaactgaaatattatatcttgggcgttacagcctttgtctttttctttagtcaccttaatacccagtcctatgctgtatctctgatagcctatataaatgacatataggaatattattttccatatgatctgttgtatggtgtatatgctatgtgttcatttcgtgtgcaagttcagagtgtaatagatttacccagagaaggtgtttctatacaatgcccctacctatttgaaattacatgcttgcccaacacactgtgaaatagttaccaaaatttgtacaaatgcagcatcttcattctttctgagaagacaagatggttttctttacatgaacaaatgaacaaaagagatcctagatccataacgtagctaaggcatctaagagtttgctgttgataatcttgctgaccaaaaactactggagagtaacacaggttatatgccatcacaaatacaatgctcatgaagaactgatttgtagagtcaatgaacctgtgtccagaattttaataggctctctattggaaggagaaagaatttcaagttaacagtatctaactttatcatagttgatgttagtaaattttaaaaaatgattttatatgtatgacaaaaatctttgtaaaatgcgcaagtgcaataatttaaagaggtcttaactttgcatttataaattataaatattgtacatgtgtgtaattttttcatgtattcatttgcagtctttgtatttaaaaaacatttactgttatgtttgtataatagaacagtaatcatttattataatctaggcaagttgtaaataaattcataattcaaacagccagtatatatgcatatatgagtgttatattgcaaaatctttgttttacttacatggttaaagcagcaagaattcttttgttgatatgtaattatacacataaaatatatatatgtatgatacatgaaatatatttagaaatgttcataattttaatggatatcctttggtgtgaataattgaatacagagtttttaaaatatc

SEQ ID NO: 165285 - DNA, 4401 bp, Homo sapiens
  Payload ID: 12546
  Gene Symbol: PDE10A
  Gene Name: phosphodiesterase 10A
  Uniprot ID: Q9Y233
  ENST ID: ENST00000539869
  CDS Start-End: 57-2426
cccagggcgccagcttcgccctcgccgccgcggccgcgctgctcttcggctccgacatggaagatggaccttctaataatgcgagctgcttccgaaggctgaccgagtgcttcctgagccccagtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatc

SEQ ID NO: 165286 - DNA, 2118 bp, Homo sapiens
  Payload ID: 12546
  Gene Symbol: PDE10A
  Gene Name: phosphodiesterase 10A
  ENST ID: ENST00000616273
  CDS Start-End: 1217-1768
gcgcggcggcggctgcggctgggtcgcggcccgcgctcccttggcgctcgccttctcgtcccgggtcccctcctcctctccatctttcttttacttctggccgccgccccccccgccccctccctcttttctcccctcctcatctgcctttcacctccccgtgcgtctcccaggaagggagggcgcagcggcggcggcggcggcgggaggaggcggcgatgctggcggaggaggaggaggaggacaagaggcagctcccttgagcgtccccaccagcagtagtcaccgcggcggcggtggcagcggcggcgggcggcggcggctcttcctctcgcctgcgctccagggcttgctgcttccagcccgtgccggtccccggccgccgccgccgccccggctcccccttggccaggccgcccgccgcgcgggctcccccggcttccccggcgccggcccaggcggcggcggccaaactccgcggcgtccccagggcgccagcttcgccctcgccgccgcggccgcgctgctcttcggctccgacatggaagatggaccttctaataatgcgagctgcttccgaaggctgaccgagtgcttcctgagccccagttcctccctcttgagcctgtggccacttggctggagcagatgcgcttccttccacttgggggtccagcccaccgggtccctgtagccggggtgagggaggccagggcctcagaaccccgcgcttccaactgtgatggcaccgccgttctccaggactcggagtgggcgcccggcctcccaccccgcgcagtgaccggcatccagagcatggactggcggggtggaaacggttgcacctccacccaggggacgcacccccaccccgggccgcgtcctgttggtcccgggcttctctggggtccggggtggtagagaaaagggaaggacaataggtcgctagggtggaagagaaaggcgccgccgcctccgactcgcaggatgcgcccccgggcccactgtggcgtggccactcctcctcgccacccgcgggcgcggggccgagagcgcgctgaggcagaggtggcagaaaggcatgtcacgggggtgggggacaagattgagcagaaaagtcaaggcaggggttcgctagaaggaagcaggcaggcgggagacagtgaggaaagaggaggcgcccggtgcgcagaggaggggggcgtcgcggtcgcggatggagggggagcagggtgaggacgggaagaccgcggcggggccgggtaggagcacctccgggtgcaggaggtcgcgcccatgggcccccgcccgactccggcgccagtcggggcgggtgcggcttcccgcggcccagagcgcggctccggagccaccgtccaccgcgtgtgcacccgagcctttgtctgcgcctcgctcaggagccgcgtttccgcggcgccttctctgggccgacgctcttccaggattgctgtttcggtttcccgctcccaactgcggctcattcccaggctttggccgacccgggtctccagggcacccgaggttgagcccctccctgcggccgaagctgctccgggctcaccgcccgctcaggcacctttggggtgcagcccccgggctggcgagcgtattcgcgccgggatcggccgctccttgcaaccccgcttcccgggcacgggcgagtccacggcggccgcgtggtcagcggcctctcgtacacccgtgcgggctccggctagcgagtcgctgcttgcgcttgattggctagcggggcgcgggcccaatgctcccgaagtcctctgacccctaagtcctcccccccggtgtctgcctcccacccccgctgcagtctaggtggggaaggggtgtggagatgggtgtgcatggacagagcatgtggccttctctgttggccagagatgtggtcagtagaagcacttttccctactgaagtgccctttggccatgcattgaaggtggtagaggatggggccccaccagctctcccggggtgttggcatcagcctataggcctggtctaggactggggttcctcctggtcccctatctggtgggcttgtgaattctttcttaagaaaataaacatctgcttttctc

SEQ ID NO: 165287 - DNA, 9275 bp, Homo sapiens
  Payload ID: 12547
  Gene Symbol: PDE11A
  Gene Name: phosphodiesterase 11A
  Uniprot ID: Q9HCR9
  ENST ID: ENST00000286063
  CDS Start-End: 319-3120
gcagcggcggcagccagaacaggagcagcgatagctcgggtttccggaacaggagccggggcagcggcggcagctcagtgctgggcacctgtgcggagcaggagtagcaggaccacggggtggggtcggcgccagccactctgagccagagaaggaaggggcatctcccagattccactgctgggaataatctccaggggaggtggcgctgaactgggaatactggtgggggtgaacatgtgcaggaacagctagaggcctcggggcaggaaaacatttggttcacgtgtaaacaggcaaggaaagctgtctgggaccatggcagcctcccgcctggactttggggaggtggaaactttcctggacaggcacccagagttgtttgaagattacttgatgcggaaggggaagcaggagatggttgaaaagtggctgcagaggcacagtcagggtcagggggctttaggtccaaggccctctttggctggtaccagcagcttggctcacagcacctgcagaggtggcagcagcgttggtggtggcactggaccaaatggctctgcccacagccagccccttcccggtggcggggactgtggtggggttcccttgagtcccagctgggccggtggcagcaggggcgatgggaacctgcagcggagagcttctcagaaagagctaaggaagagttttgcccgctccaaggccatccacgtgaacaggacctacgatgaacaggtgacctcccgggctcaggaacccctgagtagtgtacgacggagggcacttctccggaaggcaagctccctgccccccaccacagcccatattctcagtgcgctgctggaatcgagagtgaatctgcctcggtatccccctacagccatcgactacaagtgccatctgaaaaagcataatgagcgtcagttctttctggaattggtcaaagatatctccaatgaccttgacctcaccagcctgagctacaagattctcatctttgtctgccttatggtggatgctgaccgctgctctcttttcctggtggaaggggcagctgctggcaagaagaccttggtctccaaattctttgatgtgcatgcaggaacacctctgctgccttgcagcagcacagagaactcaaatgaggtgcaggtcccctggggcaaaggtatcattggctatgtcggggagcatggagaaacggtcaacattcctgatgcctaccaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcgttttgtatagggcttttctgtttgttacaagccaaacactgcctgtctttgcttcctgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagactaagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcacttaacttctacaagcttgtttccttatttgtcaaattagattacactaggaaacgattctcgaacatgttttaaccttacaactctttgttcaaataaatctttcaatgaatccccaacatataaaacgtcaaaaagctgaattcctatgtgaattataagcagggtttggacatccagagcacctacaaaccttcatctctttgattacgtacatgggggtccacagggactctgaagagtttgaaaatccctggcctagattaaacctgagagccattctagctcttaaaaaaatctgaaatttacaaaccatttttcttgttattgtttttgtttctttgtttgtttgttttttgagactgagttttcactcttgttgcccaggctggagtgcaatggcgtgatctcggcttactgcaacctctgcttcctgggttcaagcaattctccagcctcaacctcctgagaagctgggattacaggtgcctgccaccacgcctggctaatttttgtacttttagtagacacagggtttcaccatgtttgccaggctgatctcaaactcctgacctcaggtgagccacccacctctgcctccgaaagtgctgggattacaggcgtgagccaccgtacccggcccttgttattgttattaatcattatcaatcattaactttacagatattaaagaaataggggccatgttctacatgcgacattgttttcctggcacacagtagacaattcaggaaatgtctgaagaaggaatgggtaaaattaagataccaaaatggaattgaggggagagcaggtaattgtagagaaaaagactctttatggcaagaaacaaagtaaaagaaatgtatagaccgggcgcggtggctcacgcctgtaatcccagcaatttggaaggccgaggcgggcggatcacgaggtcaggagatcgagaccgtcctggctaacacggtgaaaccctgtctctactaaaaaacacaaaacaaattagccaggcgcggtggcaggcgtctgtagtcccagctactggggaggctgaggcaagagaatggcgggaacccgcgaggcggagcttgcagtgagtcgagatcacgtcactgccctccagcctgggcgaccagcgagactccgtctcaaaaaaaaaaaaaaaaaaaaaaaaaaaaaaaaaaagtataaaccagactaagaggggaataaaagcaagaagaaaaagaaacgtaagaacaccagtaaaggaaagacagggaccgagacaggtggttaagggaaatgaaaaaaaaaaaaaaaaggtgaaagtcaatccaaacaaagaaaaatggcacttccaaccaaaaaaaatgaaggtgtagaaccctgtcatcaattgctcagaaaagagagacacttgagcagggaggggtttgagaaaggggagaaggaaggagtgagagccctaaaaaataatgttcctagctaccctttacagctgtctctgcagggaagactggagaaagtagagggggaaatgaatgcaggaagaaactgcctctgcagagcaggtaagaggaggttgttcagatttatggattttattaagccagttttctgtatcactctgctataaaggaaaatagcttctgcagggctgtctctcctccttcaggtggggaacaaagggtgggtggagtcagggacagagtctggtctgcgagatcgtgacgtgtctgcagctccgaagcactgcaggtgtttctgggtaatgtgccacatcatgtttatatcacgaacgggaattgaaaatcagtctgtgtgaggcagagatgagcccacatctgttatcctccccaacaataaataaataaatagcccagacaaatggatgccagtccatctacagcaacattttaaagcatgtgctttatgacaaaactggacccagggtctgacagagactgcaggctgccgtgagcactgtagctatcctgaacattgatgctacatattgctaaggggaacataatttatagcataaaccctacaagcttccactaaggttgagttttcctctcattttcttgccgttttattggcttcactgcatggttgccaatagcaacatccactggtagcaaggggagttcaacaccattgcaatctgccatacagtggagccctgacaatgtcaaccatcaatctagtagctgtttgtaattgcctccatctatttctcctgtcttgaggtatctttcctattgtgggtcaagatttagaaactgctgactaatgccatgggtctgtgtctccatgactatgaagcagtggacaggaaggtagcagcttcctggtgccaacaaccccagaggttagaggttgaactcttgcgggtttcaggcgtttttaatcccttttctaaacaatttataattttgcaagaatgtgaggcatatgcagttatccatataatctgcttttccaaaaaagagaaaggaagtttcccagtccttattattaatgtttatttcctattggagaaagacatttgaaatatgagccttcttgtaaaaactcaaactgaccagattatgtttgcttcctcaggtctcttggcattaattgttgaaataacttcatcctactttttcgatgagatgtatttttttcagacatatttattcttactagtcactatgtagctattatgtgcacaatctacaatgtagtggcaatcctggtgggtagggacagcttcacatactgcaaagggtgccattcagtgcatagcagactggaactccctcctagcttggccaccagctgaacctgtaatcttaggactctccaagtcttagaatctccatctattacataaaagcactgacttttattcagtccccacaccaaaggaccaagacgtgtttagctttaaagaaattttccagataattttcttttttattcttctcaaataaaatagcaacaaacctaaagcagtcatcttcttaataaagacataataaaacttacatatatggggtagatgtaagcacaatcatactacagatgtatcttgagcctgtctctaattatgatgaaagatgtagtcatcaatacaatttaaaaaaagatatgtcctttttttgagacagggtcttgctctgtcacccaggctggagggcagtggcacaatcacagccactgcagccttgacctctccaacttaagtgatctttcctgcctcagcctcatgagtagctgggaccacaggtgtgcaccaccacacccagctaaattttgtattgtttgtaaagacgaggcctcactatgctgaccacactggtctcgaactcctgggctcaagcaatcctcctgccttggcctcccaaagtgttagggttagagatatgaaccaccacacccaccttatatgtccttttatttcataaaaaacaattttagattatctgatatcacacatatcccataaatggtagtcattaatttagaagtgaatttataaagttaagagaagttaaaattgcacatgcattttgtttctaaaatctgagatgtctatgcatttccaggtattgtatatttgcaaatacattgggttagaaatcatctttaacattttgtgttagtgtaataacaatattatctaatattaatgctgccagaatccagttgctttttctgtgtatcaaaatttatcataactttttccacttaacactaggtaattaaacagaatctgcccaatttattctgcagtaaaattattttaaaatctatttttcctgctgactcttagaaattgcagaaagacaaaaaccagtttcatctccagtaatagtgtgaaacaatttccttccagtgggacagaaacctagacatactagggaaagatttaaatataaagaaaaatgccttggctgaaaaaaaaaaaaaccaccaaaacacaaaaaggattcattaaagcaacagaacaaaacctaatttgggaccctaaaaactctggcaatgccactgtaatgaagtttcattatctgcttcagagtaacagtctctgaaattgttattctgctacatgctgtaaagaactcccaaaactcaaatgtatcaggaaatgtaaaggttaagtctgactacaagaaggccaaaattgcaccagcttcctaagtgaagaataatagaataaaacatatagagggcagaaataaaatgaggtgtatctggagaatttcatgatgagcatttagatttagcaatgcccaatgtcatgctgacactgtttgtcatgaccttgtcttcagctagtaatttggggttgtacttttttaaatttaattttgaatgttcttgcatgtttggtacctctctcctcactgctaaagataaattgtttatctgtataacataactacaccaatgtcatttttgtatacgctagtacacaaatgtgtttttttattaagtaatgaagtatttgctgtgaaaaatgtattatttgtgccaccgtttatatctgtgttcattttctgtgtgtatatgcgtgtgtattcgaatctcaatttttcttttactctagtttagattaagacatatttagatgaaattttaaaaataacattggaaataggaggctaagttttgttgagtctcattcccttggggggaaattgcttttgccattttattttcatgtacaataacctaaaaaggatctcctactgacttccttcctaattattattgttttacacgaaagaaaggaaatacgttttcaattgagttgtttgaaatcattcactttgtgtagatttcccagactgatgtttcattgtaagaatattacattatagacaggttggccatttcacaagcaactaatccatagttttggaagcccgctttaagagacctgaatatctttgtttttaataaaatacttagagtt

SEQ ID NO: 165288 - DNA, 3489 bp, Homo sapiens
  Payload ID: 12547
  Gene Symbol: PDE11A
  Gene Name: phosphodiesterase 11A
  Uniprot ID: Q9HCR9
  ENST ID: ENST00000358450
  CDS Start-End: 100-2151
cgcttgcagcccagggcgtgaggtgctctttctggatcgccagcctcgaagttgaggcgtggactctggccaggtggctgttccagagcaacatgggagatgctgaagcaggcaagaagacctttattcagaaatgtgctcagtgccacacagtggaaaaaggtgaaaatcacaagactggtccaaatctctggggcctctttggctgaaaaacaggaaaagcaccaggattttcttatacagaggcaaacaaaaacaaaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcgttttgtatagggcttttctgtttgttacaagccaaacactgcctgtctttgcttcctgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagactaagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcacttaacttctacaagcttgtttccttatttgtcaaattagattacactaggaaacgattctcgaacatgttttaaccttacaactctttgttcaaataaatctttcaatgaatccccaacatataaaacgtcaaaaa

SEQ ID NO: 165289 - DNA, 1781 bp, Homo sapiens
  Payload ID: 12547
  Gene Symbol: PDE11A
  Gene Name: phosphodiesterase 11A
  Uniprot ID: Q9HCR9
  ENST ID: ENST00000389683
  CDS Start-End: 151-1620
tggaaagatgttacttcatctcccaggtttgctcactgcaaatacaatcctgagaactgaactagggccttaaagtcctgacatgcatggcttggttttgtggattgcctctctcaacaggtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagca

SEQ ID NO: 165290 - DNA, 2102 bp, Homo sapiens
  Payload ID: 12547
  Gene Symbol: PDE11A
  Gene Name: phosphodiesterase 11A
  Uniprot ID: Q9HCR9
  ENST ID: ENST00000409504
  CDS Start-End: 92-1819
aaaagtccactgtgtgttgggaatagattatgaagggctttgagtgtaggccctgtaagcaataggaagccatggaacagccagaaaggttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctg

SEQ ID NO: 165291 - DNA, 619 bp, Homo sapiens
  Payload ID: 12547
  Gene Symbol: PDE11A
  Gene Name: phosphodiesterase 11A
  ENST ID: ENST00000427127
  CDS Start-End: 362-472
caagaaatgtagagggagaagagtgctggaagatgagtcaagaaaagtccactgtgtgttgggaatagattatgaagggctttgagtgtaggccctgtaagcaataggaagccatggaacagccagaaagcttcctgtctgtcagatttccccattcatcaggccacagacattcttgggatgtagctagggaagaagtccagctgtagatacttttgagtttagtaggataatttttatggttcccaatcccttttgtggaaagttgttgctagctttatgctgtaggaacggcttttctgaatattcttttgctcaccatcccagttcactcaacatcttgatgcagatatacaaggttatgcagatgtatcttccattttgtggaatcgccatatctaacgctcagctctttgctgcctcaaggaaagaatatgaaagaagcagaagttatgtaagggatgtgtattagtgaaaatgtctcaagtttgaccaagaacctgtttcttcctgatagtgaggaaaagctgctttgctttgctagaggtggttaatgacctctttgaagaacagactgacctggagaaaattgtcaagaaaataatgcatcgggcccaaa

SEQ ID NO: 165292 - DNA, 1204 bp, Homo sapiens
  Payload ID: 12547
  Gene Symbol: PDE11A
  Gene Name: phosphodiesterase 11A
  ENST ID: ENST00000436700
  CDS Start-End: 1-409
agtgctgccccttgttgaggaaaggaagatatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcgttttgtatagggcttttctgtttgttacaagccaaacactgcctgtctttgcttcctgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatcta

SEQ ID NO: 165293 - DNA, 1310 bp, Homo sapiens
  Payload ID: 12547
  Gene Symbol: PDE11A
  Gene Name: phosphodiesterase 11A
  ENST ID: ENST00000433879
  CDS Start-End: 1-1310
atcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacag

SEQ ID NO: 165294 - DNA, 8773 bp, Homo sapiens
  Payload ID: 12548
  Gene Symbol: PDE12
  Gene Name: phosphodiesterase 12
  Uniprot ID: Q6L8Q7
  ENST ID: ENST00000311180
  CDS Start-End: 104-1933
agatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtatcattttgtcatcaatggcagcattccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaaattgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcgtgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctaccaaattgtgccttcctaaataacatttttgagagcattttaacagcagtttacaaatatgtaaataatagattaaaaccaaatcttgattctcttgtgaatttttttttcattttaaaaatatgtttttgggctgttttcaaagaaagatgttgatagaacccttagagtgacttgggagaaaacaaagtgtcacatcaaaaagttgagaaacattttgaaagaaaaaattcgaacatgcccatgaaaaaagcatacagcttccacattaacactggctagattaaactctagtcagaaaaactcagcacttaacagacattccatgtcctatatccttaattttgatgttttctgactaaacaatatactcagattgtatacaggcatttcacattattaggacatggaatgttattgtgaagtgccatatactgtgatcaaatctccagtatacggatacgttaaaatgattggagtccaaaggtagggaacactaagaaaatgtataaatagcatacacatttctttgtactcatgagttagaatgcagtgttattcagaaatgtctgtttaaagcacctatgtgattgcatttttctattacatttggattttttagtacatttaattttaagaaaacatgggaaatctagcgactttctatggtaaaccacattttataatgtcacaagttcttgctataggaattaacattctagaattttatattgattataaaagagtatttcagaacatattattctgttaaaatgaactcttgcacagttgccgctacagcaaatgtgtctgccaataatcaaaattcatgagcaaacaatcgtttctggctgtaatgtatgttctttttgaaattctgtatgctaaaatcagttgtttcaaaatttcaagaattccactgagtagtgatttttctgagtactaagctatgatctcatcagaatgtgctggtttcagtctggagatagatttctgaggagcctaatacaagggagagaatgtccaaagaacactactgtggaaagttcttacgatggaaattgacatcttttgtatctcattctccagccgtgaaataaaggcagaggttccctgcaaactagtttggttgggataaatccaatatttatatataatgaaaaataaaagtttgcattattagtttatcacaagacccatgtgacaactcagaaaatattctcagcataatttttttaagagatagagtctcactgttacccaggctggagtgcagtggtgcagtcataacttactacagcctcaaactgcggggctcaaatgatcctcctgcctcagcgtcccaagtagttgagattacaagcccaaccttccataactgaaaactaactttctttttttctttttttattattatactttaagttctagtgtacatgtgcccaacgtgcagatttgttacataggtatacatgtgccatgttggtttgctgcacccgttaactcgtcatttacattaggtatttctcctaatgctatccctcccccagccctgaaaatgaattttttaaacacaaataaaaaatatttcagtgttttgagaattttaataatttgcttaatatagtacaggaaggcaacactatctagagggccaggcatagtggctcttgactgtaatcacaacattttgggaggctgaggcaggaggatcacttgagctgaggagttcaagaccagccttggcaacattgtgagaccctatctctgcaaaaaataaaattaaccaggcatggtggtgcatgcctgtagtcccagctgctcaggaggctgaggccagaggatcacttgagcccatgaggtcaagcctgcagtgagttgtgatcaaggtgcgctgcactccagcctgggtaatagagcaagaccctgtcttcaaaaaaccactctagatttcatgttgtagggggtagggaggacaatttttaacagctttaactgacatgggtaatatataagttctgtgttctcactttatatgaaagtacttttttaaatgttaaaaatactagagctgtattaacttcgtgattttatttttcttcttagcactaacttcaaaataaccatacagtactgcttgtaatttttgtatttttagtagagacagggtttcaccatattggccaggctggtcttgaactcctgaactcaagtgatctgcctgcctcagcctctgaaagtgctgggattacaggcatgagccacggtacccggcctaaattttaattttatatataaatggcaaaataatcttaaatatagtaaatctgttcacctatctgctatgctagcaaattctgggttgtcaaaaatccatgttcatactgtcagtgttagatttttactcataatttaaaatttccccgcaaaatttcacagaaaactgaattattcatctctatcttctgtccaatttatgtaatgaatgtatgtcaaagcatttatataacacagtccattttgcccagtaattcactttaatgatgttatcatgaagtattgatgtactttttttttagtgtattgaagtattcctaggttgcatttgtgctagtttcataccatttgtgttccttatatattgaagatggttcagtaggggaaatggataggctttatttagttggctttcttatactggataatataaacactttttttttcttttttgagacagggtctggctttgtcacccaggcttggagggcactggtgccatcacggcttactgcaacctccacctcctgggcttatgcaatcctcccaccacagcctccccaaatagctgggactacaggtgcgcaccgccacacctggctaatttttgtatattttataggcaaaaaaaaaaaaaaaaatggtttcaccatgttgcccaggctggtcttgaaattctcagttcaagcagtccacccacctcggcctcccaaagtgctgatattacagacatgagccaccccacccagtcagcacacattttttttttttttaaataagacagggtgttgctgttgcccaggctggagcgcagtggcatgatcatagctcactgcagcatcaaactccagggcttaagcgatcctcccacctcagcctcctgagtagctgggactataggtgcatgccaccatgcctggctaattttttaaattgtttgtagagatgggggtctctctatgttgcccagactggtcttaaactcctgggctcaaatgactctcccgcttcagcctcccaaagtactgggattataggtgtgagccagcacacatagccctttttttaaaaaaattaaaaacaaattttttctccagaaaaaaacatatttatcaacttttaaaaacattttatgggtacatagtaggtgtatatatttatgtgggacatatttcttttgatagagtaaattgagtattcatcacatcaagcattcatttgtgttacgaacattccaattgtactctctcagttattctaaaatgtgatatacacacttttaaaaggatttattgcgctgggcgcggtggctcacgcctgtaatcccagcactctgggaggctgaggccggtggatcatgaggtcagatcgagaccatcctggccaacatggtgaaaccctgtctctactaaaaatacaaaaattagctgggcatggtggcgcgcgcctgtagtctcagctgcttggggaggctgaggcaggagaatcacttgaacccgggaggcagaggttgcagtgagccgagatcacgccattgcactccagcctggcaacaaagcgggactctgtctcaaaaataaaataaaataaaattttaaaaaaaggatttattgcatataattcttatatcccctgtggaatagtttggagaaatggtacatccaaagataaaatcagttagaaataaacagtggccttcctcagaaaagctgggctatagtgttttgggtatcttaaaccaagaaagggtatttctatcccagctgtagagtttttaataattctattataaataatggaatcaggccagcacagtggctcacgtcacataatcccactctccttaagagctttttttgtcactgcatatcaactcagttgacaaggactggcccccaaaagaagctgcatactcacttggcagtcactccccattctccctagctcctggcaacaacttaacctgtctctgtggatttgcctattctggacatttcatataaattgaatcataatttatgtagtcttttgtgactggcttcttttacttaggatgtttttaaggttcttactgttgtaggatgtatcaggagtttgtttttatgatgaatgttccatcttatggacgtaccacatttgtccattcattagttgacagacatttgaattgcttccacttcctggcttctatgaataatgctgccataaacatttgtgataagtttttgagtgaatatgtgtttttgtttctcttgggcacatacagggaatggaattgttgggtgctgtgataaccttttgaggaactgccagacttacggaaagcagttgcactattttgcattcccaccaagcaatatgagggttccagtttccctccatcctcattaacactttattatctttttgattataggcatcctagtgtcaagtggcatcttattgtggttttgatttgcatttccatgatggttaacgatgttaagcatcttttcatgtgctcgttggccatctatatatctctggagaaatgtcttttgaaatactttgcccatttaaaaatgttatttgttgtttagccacccctccttaaaaaataaataatataataatcc

SEQ ID NO: 165295 - DNA, 3040 bp, Homo sapiens
  Payload ID: 12548
  Gene Symbol: PDE12
  Gene Name: phosphodiesterase 12
  ENST ID: ENST00000487257
  CDS Start-End: 105-1523
gagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtaggttttatttggtatcacaagtgacttaaacacgcttaaagttgtttaaagtgttttacacaaatgcatatcttgaacgtcacccagagactgtaatttgtgtagtttttcttttttaacttaaagacaactttaaaaaatacttacattaatgttttttatattcataggtgggtatattcgcctcattcaaatggcagtagccttggctcacataagacatgtttcatgtgatctgtatcctggcataccagttatattttgtggggactttaatagtacaccatcaacaggaatgtatcattttgtcatcaatggcagcattccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaaattgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcgtgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgtta

SEQ ID NO: 165296 - DNA, 2338 bp, Homo sapiens
  Payload ID: 12549
  Gene Symbol: PDE1A
  Gene Name: phosphodiesterase 1A, calmodulin-dependent
  Uniprot ID: P54750
  ENST ID: ENST00000351439
  CDS Start-End: 419-1978
gagggacttagcctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgttttc

SEQ ID NO: 165297 - DNA, 2015 bp, Homo sapiens
  Payload ID: 12549
  Gene Symbol: PDE1A
  Gene Name: phosphodiesterase 1A, calmodulin-dependent
  Uniprot ID: P54750
  ENST ID: ENST00000358139
  CDS Start-End: 150-1655
acaatgattcctattccacttgttctacctacactgtatctgatcactgcataagagatagtagaaatggcattatctttaaagtagtgatattttcaagccatgaagtttagtgacttgctgaaatgggctagggaatctaatttcaaatgggcaaaaagataaacaaactattttgctttaattttctagttcagtgttttaggggtaaatcaaaaccatccaaatgtcagatcagaaagaaagttaaaaatcatatagaaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgttttc

SEQ ID NO: 165298 - DNA, 2034 bp, Homo sapiens
  Payload ID: 12549
  Gene Symbol: PDE1A
  Gene Name: phosphodiesterase 1A, calmodulin-dependent
  Uniprot ID: P54750
  ENST ID: ENST00000409365
  CDS Start-End: 402-1991
ggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcataggcccgaaacaccttaaagacttctgtcattttaaacatgagag

SEQ ID NO: 165299 - DNA, 2000 bp, Homo sapiens
  Payload ID: 12549
  Gene Symbol: PDE1A
  Gene Name: phosphodiesterase 1A, calmodulin-dependent
  Uniprot ID: P54750
  ENST ID: ENST00000410103
  CDS Start-End: 85-1692
gaattctgatgtgcttcagtgcacagaacagtaacagatgagctgcttttggggagagcttgagtactcagtcggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagca

SEQ ID NO: 165300 - DNA, 4885 bp, Homo sapiens
  Payload ID: 12549
  Gene Symbol: PDE1A
  Gene Name: phosphodiesterase 1A, calmodulin-dependent
  Uniprot ID: P54750
  ENST ID: ENST00000435564
  CDS Start-End: 202-1839
ggtgaggtggtgagcagtggatatatgcctgtcaaagtcaatagcaaatctgtcagagtcttccctcagctttgtacatcagcactgttttgatagataagagaggctactgtataagtgtgtaagatttgtaatggactgaggaatgcttgttctagctgctgaaactgactgtaactgtattgtcttaggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcataggcccgaaacaccttaaagacttctgtcattttaaacatgagaggacaatgaaatcagcatgaaaacatcctaaattctcaactttccacaaagctatggctcttctttcaacatagaattggattgggccattttaattgactcctatacaaggaattaagaagaacataaattttgagctagtaactctggccaaataaatacactcaagtttttatcagagtttttggccagtgcttctgccatttttttccctccacaatttggccttcttcaatcaagccagataaatttttgagacaaaagtcagacagtttttaatttttcttgctttgaaccctgtcataatgactgtgcaatacatgtgcagaagatgaggtattttaaaatttacttccttgcactgtcttacacagagtgctataactataaatttttcaaggtcttaaataaaaggaagcaaaaacaaaattattgaaaaattttttttgttgtgctggggaatatactatttagattgtccttcttattttaaatgcatgggaacagaatgacaggtgggatgctgaggagctggttgaagcatcagagcaatgctacagtccaacaatggagcattagatccccagctaggtgacctgatgaacacctttgtaaactctcatactgggaaatggcagtgaaacctttttctgaacccgtggaccagcctgcgtccgtccccatggtttcaaagcacgaatgcattacctccatggttgtggttacaagcaagtcacatgctatctacagttcatgataacaagaccgtcaaccattgctggagacagacactagaatggaaaatgaaatttgccagcgggatgtttatcccatcagaatgtaacaaaatatattaccagccaagagataagagacaagaatgtgtgtgtgtgtgtgtgtgtgtgtgtgtgtgtgttcaaaaatgtctatgaaaatgaaaacccacacttttctgtacagataacattatttgatgtgacttttatattttactacacagaaacaaactgcagccctcagaggccctgcttccttgtcatgttttgcctgagcatgtgcaaagtctttcctttgcttaaagctgaaaaactacctttatgcattgttagctgacaagaaagatcaagcacaattagatgttgtaacttttcactgtacaagcattgcaatgattgtgagcttcagtgaatttatctttgtgaaaggtaaaaattggctggaaagaatcaggagtagccataaattaaatcatgcaaaggaggatccatgcatcctaacaagttttctgctgcatctgcttccttcctgggctccacaatgttaagcaatattttagaaaagggtacaattggaagcttttaagcctgagtggtgagattttataactcacaacttagatctcttttaatgtgtaagccatattctatatgcatatttattatgcatcattgtaatttaagatatatttggatgtaggctgtataaatgcttttaattgttctgtgaatagatccttagctttagtttcacctgaatcttgtgcaaaacacagctaaataattgaattgtattatagacattatgaggtaattgatcttttaaatgtaaggagtaagattgatctataataatgtgctggggaaaacatttatagatatgtacatcatggttactttttgtcctttcaaatggactttttatttctatttatggagagactgtaactactgcttttaatgtctttttaaagcaagctatttaccagcttgaaaatatcatgcatttaaaatagaatctatctggggagtctaattactattgttcctatttgagccagttgtctttcagtaaagctatagaatctctcaaagaagtaaatagaaatactacttcttaaatgtcataggaagcatatccactttgtttctattagtactttaagatctataagaccttattactaaaaagtagaggaatataaagaattcatcaatttctgtatatgggctttaacctaattttccaggttatgcgacttataaagcactgtgaccaaacttccagagacagtaaaaaaaaaaaaaagaaaaaaaagttttactccttcagaagtattgtcatgctactgctgtacttattttcctaatctctctctatctgctatactccctccttttctttctttttcttttaagcttttatatttattccttcctttgttttcctctctgtaagacagctactactgagcactaattagtagaaagtcagagtggaggttatctgtgcatgtctttctgcaaacattactgttgaggccatctgaagagagggattgataggttaggctgttgcaccgtgaatgtcctgctttgcatttttaacctcagctccccaacatatatatcttgcagtttatatgccttttcatttaaccgaaacctcttttatttaatttttaacataacaacctacaattcttgtgtttttattatgctgtatttttctgtgtttcttattacatgtgattgctaaataaatcatatttgagggaaaacattgtgaaacatttggtgttttatgcaattcaatttagtgaggcattgaaaagttggagaaattgggggaaacccaaaggagaccaacttaaaaattgatatgagtttggtaagaaagtgctttttgttccattaaataaatactgattgaattacttattattatacctattattcataagctcctggctggaagcatggtgcatatatgcatatggcaatatttcctctagaaatttcaagtcttataaaggagataatctacacagactgtaatttatacctaataactagaatgccacataaaaaagtaaccagttgcaaataaaatgcacctatgtatatttgaggaggtaaaaaactgcttctgtcttcagagctttcaggactaagtggtgcatcagttggcatttagtaaataaaaacaagtttataaacattgccta

SEQ ID NO: 165301 - DNA, 3444 bp, Homo sapiens
  Payload ID: 12550
  Gene Symbol: PDE1B
  Gene Name: phosphodiesterase 1B, calmodulin-dependent
  Uniprot ID: Q01064
  ENST ID: ENST00000243052
  CDS Start-End: 437-2047
gtaaacacgcactcacatccgccagtacagggcacacgcagccactcgtccccggcgcctgtgtgcgtgcgctcgcccttgggcgcttctgtctgtgtgtgcccccggcttccaatcgttcctttgggagggggaggagtggctgtgaggagtgagagactggcgggcaggctgaggagaagggagggagagcagagggaggggggaacccggccgggggaggaggagagaggcgaggaggcggctctggcagcgcgcggcggcggcggcggtagcggcagcagcagcggcggtgcggagagcttggactgggagcccaaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaataagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccctgggaagggctggaataggatagaaagctgggggttttcagagccctatgtgtggggaggggagtggattccttcagggcatggtacctttctaggacctgggaatggggtggagaggacatcctcttcaccccagaattgcgctgcttcagccccatctccagcctgatcctctgaatcttccttccctccctttctgatacagtgactggggcaaaaggagccattgtgaccaggggctgcgggaggcctttcctgggaccttccttgggactggtctgggcccctggggcttgtcgcctgccctgagtccggagccctttgcctccttcctctcccctggggctgggaggctccatccgaccaatgtctgtaaagtgctttgaggatctccccagcaaagcaccttcagaatgtatcgacaccagctgggttagggtcaagggtgcctggggagggtgagtaatcctgcattgctaaaagagagggtctgtcccctcctctccacgtcccagaactggcccagctgcaggcactaagaagctcctcccctgagacaagtgaggggtagtcggtgaaaggcagatggacaaggggctcagggctgctgccttcctgtcctctggagagaacccagccaggcgcggtgccccttcctctcctcaggctcctccttgcccccaccttgccccaggaaaggccaaagtccaggtgactgccctccttctttcttgtaaataccaaccatgcatttgtacagtgggccctgttcatgcgaaatccacatccatggtctcctagacctgctaccctggtacttccaccctaccccaccccgagaagggcagagacgcatgtgactcacccctgcccttggtttcccagacccctgctatagccagagaacaataaagaagggagaccagg

SEQ ID NO: 165302 - DNA, 1711 bp, Homo sapiens
  Payload ID: 12550
  Gene Symbol: PDE1B
  Gene Name: phosphodiesterase 1B, calmodulin-dependent
  ENST ID: ENST00000538346
  CDS Start-End: 137-1624
gattctctttggcacagatgttggcaggtgcgaggaagcacggccctgacacgcgtggccaggccacatgtgcaaggcatgtgcggagcaagctggccagttggagcgggcttaggagttgcaaaggctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaataagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctcc

SEQ ID NO: 165303 - DNA, 2209 bp, Homo sapiens
  Payload ID: 12550
  Gene Symbol: PDE1B
  Gene Name: phosphodiesterase 1B, calmodulin-dependent
  ENST ID: ENST00000550285
  CDS Start-End: 119-694
aaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgctgcgctacatggtgaagcagttggagaatggggagataaacattgaggagctgaagaaaaatctggagtacacagcttctctgctggaagccgtctacatagatgagacacgggtctctaggctgtggaagcacctgctgtctttcctctgtgactccccttctggggtctcaggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaataagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctca

SEQ ID NO: 165304 - DNA, 2150 bp, Homo sapiens
  Payload ID: 12550
  Gene Symbol: PDE1B
  Gene Name: phosphodiesterase 1B, calmodulin-dependent
  Uniprot ID: Q01064
  ENST ID: ENST00000550620
  CDS Start-End: 129-1679
agttgctcagttctactgggacctggaggaggaaggcaggggccaaagaggaagttgtcccctcttgggggccctggggctcctggggtcaggattttgatactctgaagcaggaaactttgattcccatggcaaaccctgttcctgttcagaggagccacctccagggccccattctcaggctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaataagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccct

SEQ ID NO: 165305 - DNA, 628 bp, Homo sapiens
  Payload ID: 12550
  Gene Symbol: PDE1B
  Gene Name: phosphodiesterase 1B, calmodulin-dependent
  ENST ID: ENST00000611899
  CDS Start-End: 183-335
gcgcggcggcggcggcggtagcggcagcagcagcggcggtgcggagagcttggactgggagcccaaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgccccatggagtgatcttctatggttcttaccagttttgaaaatcatgctgccattctcctttttctgtctatggatgtggagctgctgtgaagattgcagcataaactatggttccctggacctctggagaaaaaggagtgtcatttttctcatgccttggctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcg

SEQ ID NO: 165306 - DNA, 2898 bp, Homo sapiens
  Payload ID: 12551
  Gene Symbol: PDE1C
  Gene Name: phosphodiesterase 1C, calmodulin-dependent 70kDa
  Uniprot ID: Q14123
  ENST ID: ENST00000321453
  CDS Start-End: 461-2590
agcaagaaaacatcaagagtttttgagtgtggtgtgtggttcccttcgtccccatcagtcgcttcaatatttcaaaatggatccggttctgtggcgggtgcgagagtgaggctgtgggggacctccaggcccaacctccgcgaagcctcgcggcttctgcgtgccctggccccgggaggataaggatttcccttccctcctacttgcgcgcggagccgagctcttgttgaggtgagggttccggaagcccacgcagctccgcaggtcggtggtggccgcggctgccctgcgggggtgagtgtgcccggccggggtcggagcccagcgtgtgcccggcagacggcggtgcccgcgcgcccctccctccgcgcccgcggtgacagcccagacaccagcccgggcgctgacagacgacttttctcacttgtcagttttctcgcttgtcagcagagctgctgctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctggatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaa

SEQ ID NO: 165307 - DNA, 2420 bp, Homo sapiens
  Payload ID: 12551
  Gene Symbol: PDE1C
  Gene Name: phosphodiesterase 1C, calmodulin-dependent 70kDa
  Uniprot ID: Q14123
  ENST ID: ENST00000396182
  CDS Start-End: 470-2374
cggctcccgctttgctcagccgccgcttttctctcccttctcactttctctcctccccacccagccctccttttcacctccaaaccctttagctgcgcgctgatcgcttctgtggctttgtttgggggtagggggagaatacgaatagacccgaggtgctttctcttggagctggagtccaatcccaatccctatctctatccctatccctgtgcttatccctgggcattagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacggggaggggacagcccaaactatctcagcttcaccgccagtggtcacctacctgcagctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatgattcacaagagtaaaaaagacctcatagacaataaaagaggctgccagtgtcttgcatca

SEQ ID NO: 165308 - DNA, 8852 bp, Homo sapiens
  Payload ID: 12551
  Gene Symbol: PDE1C
  Gene Name: phosphodiesterase 1C, calmodulin-dependent 70kDa
  Uniprot ID: Q14123
  ENST ID: ENST00000396184
  CDS Start-End: 206-2110
gtggtgtgtggttcccttcgtccccatcagtcgcttcaatatttcaaaatggatccggttctgtggcgggtgcgagagtgaggctgtgggggacctccaggcccaacctccgcgaagcctcgcggcttctgcgtgccctggccccgggaggataaggatttcccttccctcctacttgcgcgcggagccgagctcttgttgagctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatgattcacaagagtaaaaaagacctcatagacaataaaagaggctgccagtgtcttgcatcattctagctgagcttcttcattctccttcttctccttcttccacaaagacccatatctggagaaggtgtacaactttcaaacacaagccccccaccccctgacccttggccttccctcacaccatctccttccaggggatgaatctttgggggttggtttgaggtcttagaactctgggggatattcccctgagcaaaacaaacaacgtgagatttttactcaaacagaaacaaaacatgaaggggcatcctcaaaatcctttgctaatgacctggctttcaaggcatctgtctggcctgatgagaatggacatcctggatatgctgggagaggcctgaaaaaagccacacacacagtaattgccattttatgactgtcaatgccgttactttaaatgttgtcatttttgcactggctactgatgatacagccatgctgacattcatcaccgcaaagatgatgattccagtctctggttcctttcctgagtcaggaacatttgttttctccaatttcctttcagacttaaaattgttcttatgctttttttcccacttctgtaatacagaattctgtttgttttctaaaaaagattattctataggaatctttatttgatggctaatttattttctctgtgcattcattagtataaacctgaatgttcagctggtgactgtactgttgagtgggaacccattgtttccactggtagcattgataactaagtggttactgaaatttttaccactggctggacatcttcttttggatatctgtggttttatttcatcactcttctttttattcagtaaagtgctaagggaattagtatcagggagatatggcagataattctttgcattttagtgagtttttaaaaatacaagatagaagtggattaatagcacgaataaaaaataagaatagtagatgtagcatggaaagagaataacattgcagcccccttgagaccaaattacaggtgggatctaagggagtgcaagtaaagtgggattttatgagtctaaatgatgtgatttagataaaagtgattcttaaaatgtggttattggtcacacaggaatctctgagtccttcccaagagtgaagcacatgaatatgctgatgatgaagtggggattagtaatagaaagagagctaggcaataggtttaagtgtattccccactacagatttaatttctacatgaaaaagcacgagaacagatatttaaacgtccttttattactaaggtgaaatattggcattttttcaggcagaaagaaagagactgtatgtggtcttcctggacctttgccttgccaaaatgttccccaacagaaagatctgaagaactttgtagtatcgaatgcacaacagcatgctgatatttgaacagatttcttctgtcagctttacattttgccttggagaaacacttagatttttctgttgtgctccctgtgttcataacaatgacctcaccacataatgtggccagaaattcaaatgacttcaggggcctagcaggtcaagtaaatgaataaagcaagccatgtaatatcacagtcattgtggtaaatggcaattcatagtgggcctttgtatcagcaagacaggaaggagcaatggggactgtgagaaattggagagggtgggtgctgtcaaaacagggtagttggtaggcagcaactgaatttgagctgtgtggggatgggggtcctagatacctaggatttgatataagctctctccaaatttttacatattgacaactaactcaaaaacttacaaacactgtgctaatcaaatgaaacatgcctgtgagctgcattcaatccatggggcattggtttgcaagctatgttcttagaggtggtatgattttgtattgaaattaaatataaccaagagtatgtcaatttttgaccttggaacctggaccttttacctcatttatattctgtatttttgtatgtggggctttttggccagtcaaaatagaaagtctacagcttccattttataatctaacaagcaacaagaaacaacatttgaaaaagaaacaggaatatagccattttttctagcaccaataaaaatggaaatgtttttcatttgctttaagtcattaatcagctgaaaaagaatagaaagagaatttcattccataaagaacttcacctaaaactctcagtgaagcaaaacaaaactccatgtaactcactcttagctttaaatctttaaaaagtgtttcgaagggatattgagtaaaaatgcagttatctattaaaaatacaaaatgctatattatatgatgctatgaattgatactggagctgataaaacattaaagtaattattccaaatcagtgctgactgcaaaagcaatatttccaaagctctagcttattttctgcggtcttttaattcccttgaaatagctttcttcaagttgagcagcaatttgggacaaacattattctattgcacagattatggcatcttactctggtttacacacacagagcaagggcttacacacctgaattaagaattaactagcatgtggggacagcaatagggatagtcctaccacagacgaaaccatgcgctctacacgtccctggataaaatgtgacaagttagcccttgaatttgggtccccatgtcaccaaatagctctatatttaagttgtgttaatgtggtacgtttcagtggcataatgacccattcttatcgaggcctttgttccatattttatttgtgccaatctttcttaggttatgagccctaatagtttatggcagcagacaagagactcatttctaacccattaaattcaaatggactttcttccactgtccatttcatttttggagctgttataaactaccgaaaacatttgacaggatcccattgtggatctgatacacttaaacagtaaaatgatatctaaacatctgaaagccaaagaataacctagtgcacgtgttcattcatttgtagaatttaagccattgtattatattttccacttggaaccatgcctttagatacaaaagtgtaaagtaaaaagcaacattatcatgggatgtgagacggtaatccaaaagttgaagaccaatttttgttatccatattttggaagtatggatactgtttattttaatatcacttctctcatgggtcacttttccttagataggtaggtaggtagatagatagatagatagatgatagatagatagatagatagatagatagatagatagatagatagatagatagatagatagataatataatatattttcttctttcttaacctatgagcagagactttgatgatggaaattactttgtaacattccccatggagcctaggaaaaacaatagaaaaaaagcatgaaatctttttctcatagtgaaatagagaagattctaagattggaaatctgtgtatgtggtgttctatcccaaataaagagaatttagggaattcaggcaacaatttttttcctaattggaaactttgttctgatcctgagatgcccacacaccccacaggagacgcagtgctggcccaccacagtgtttggaacacggtcagcattcaggaaacacattcaaaatcgtctaactgaattccactatccacttgtgaatgcaaacaaaattcaaatttccctgaaaatttattcaacttctatatgccaagcacactgctaaaggcttatcttctaagtatatgcaggcataccctactcacacaaatagcttattaccagagataggaaattgcaggtaatttgggagaaattgtcatagccaaatttatggaaaaaataaaataaaaacttctctatggcctcttgatttaagaaaaaaacagaacaatacaaaaaaaaaaaagcactaaaacaggatttatctgagaatgtctttccaaaagggaagatgacaccaatctatataaaacgtcagtggatttactgagaatccgagtggaaacttttaaaaccttaaacagactctcctacagcaaatagattctctatgtgcagcatgaggaatcactgcatagttctgctccaccaataatatgattggtacagcaccaaaccatggcaaagttagatgttaaagaacataatgttgcaataatgatgttatattggatcttatgcatgaacaaatggaaagtaataatttatcaactgtgatccatgattaaaggcctcattatcactaagaaaatgaacttaatgaaaaaaattataatgagcaatgacaatattcctataaaacctccctctgggtatcaagagacatattacctgccaaggccagattttactttttaaggtttcctctctctcaccaaagacactagtgggcacagaggtgacactagagttagaatgttaccagagtcatttgcattagacagtttatctgatcatgaacatgttcccagggagattagaaaaatgggaagcaggcctctaaagatcctccttggacatttgtaaaaaggctggctgcttctccaggaatgtctgaattaagcaagaattgtgccactgaaatagcttcttgtttttatattaaacaaggaacgattgtgcagtggatgacctggactgaaagatgtatgatggtcaagtttaaacatattaattcctgattgttttcttaaatacccaccctagtcattttttggaaaatattgccagacatatttgacatgaattcatgtttattctggcttctgttcccaagcagaagtggattaaccctggcaatggctggcttcactaactgtacttgcacccagcctgggctgccatctgctcagccaggagaagcagggagtggggtgtgggccctttaagttcgctcagggcacactcattcagtctcccctgaggagaccttgtccccctttgtggggtgaatgctggctgttgcaggccagaggcagtgccaactggagactcatcctctcagctttggtcagcttcagccacgtattcttcatgagtgctggcttctgaacctgcaggatcatttctcagtcagtttatggtgcagggtaattcatttaaaataaagcccattaaaaccccatggctatagaatgggttttaaatagattgtcctggagacacatcattgtatagtctttgcttccctctcatgacctatcttggagtagaatttgtgtactactgtccttgtctttgagtgggtatatgtgtgatggtacagaaatacagtcacatattatattaatatatatagatggataggaaaaacctacagccataggtattgtccaataactgattctagaggtagaactatagagtatacatttccttttttcttgctttgatgatatttttatacaattttatatgctataaaattttcaaaaatatatttgctattttcatttgtagagcttggttaggtttttatcagctcttgtgcccactgtacaaccagattcccctcatctaatttaaatgtcttccctttttcaaactctcctttatgttttcctttttttttcctcccatttttctacccttcacaaattccttcttttgcttctgtccaggtaacccattctgcttgcagtatcattttagcacgtacaaacacaaaataatgggaaaaataaaagcaccttgttccatgcaattcgtatgggaaagttttgggtgtcaaaggtcgctggggatagatggggaggcagaaatagcttgggaaaaggaagcaggaaaaaaggaaatctttatgggaaatcaattacccaaagcaaggtgagtcacctagaggtgaatatgatgttgttattgtcctcccttagtgtacagcacagtttttgctctcacagggtttttctctttaggatgcgtagcaccctatgcattaaatacatagcatcctaaagacaccctactcaccttgagtctgtaggctctttcctgatgagggcactggccatatatgaatggaaaactcaactcatctcctcagctttagatgttgctgctgttcagctggatttgtgagaaatatctggattactatcaagaacatttagcaagactcaaaagagagaggcaagcagaaccaaaacccaaacctcaaccaatgactagctgaataaacaattctttggaggaataaggaaggtatttctggatgtattctgagaatgctcttccaaaagggaagatggtaataatggacttgttttgatttcatggttgtgatagaatgtacttccatgatgtgaaatacacttctggcagataaaatgcaggttgtaatttgcatttgtacatcacagggtaaaagaatggccatccattctgaggaagagtgttctgttctctaagatgctgcttaaccaatgttatccaaatgccatagcatcatatctccaaatacaagattaaatcataaggattcatgtaaaacagagtatactgagctgttctcagaaaaattaatgatgtgtttattgtaaatctttattgcacagatgagcctgacagtccttcaatgtataattttcccccagcatctagtaatgcataagtacttgtatgttcttctgattaccaaataaaaacaatgagttaacctcttaattggaattggaaaaatgaaaa

SEQ ID NO: 165309 - DNA, 605 bp, Homo sapiens
  Payload ID: 12551
  Gene Symbol: PDE1C
  Gene Name: phosphodiesterase 1C, calmodulin-dependent 70kDa
  ENST ID: ENST00000396189
  CDS Start-End: 466-605
aagaaaacatcaagagtttttgagtgtggtgtgtggttcccttcgtccccatcagtcgcttcaatatttcaaaatggatccggttctgtggcgggtgcgagagtgaggctgtgggggacctccaggcccaacctccgcgaagcctcgcggcttctgcgtgccctggccccgggaggataaggatttcccttccctcctacttgcgcgcggagccgagctcttgttgagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacggggaggggacagcccaaactatctcagcttcaccgccagtggtcacctacctgcagctatggagtcgccaaccaaggagattgaagaatttgagagcaactctctgaaatacctgcaaccggaacagatcgagaaaatctggcttcggctccgcgggctgaggaaatataagaaaacgtcccagagattacggtcttt

SEQ ID NO: 165310 - DNA, 2952 bp, Homo sapiens
  Payload ID: 12551
  Gene Symbol: PDE1C
  Gene Name: phosphodiesterase 1C, calmodulin-dependent 70kDa
  Uniprot ID: Q14123
  ENST ID: ENST00000396191
  CDS Start-End: 457-2586
gctcagccgccgcttttctctcccttctcactttctctcctccccacccagccctccttttcacctccaaaccctttagctgcgcgctgatcgcttctgtggctttgtttgggggtagggggagaatacgaatagacccgaggtgctttctcttggagctggagtccaatcccaatccctatctctatccctatccctgtgcttatccctgggcattagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacggggaggggacagcccaaactatctcagcttcaccgccagtggtcacctacctgcagctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctggatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaaaaaaaataaaattcctctcattgccacttttttcaatctctaaaagttagttgccccc

SEQ ID NO: 165311 - DNA, 5109 bp, Homo sapiens
  Payload ID: 12551
  Gene Symbol: PDE1C
  Gene Name: phosphodiesterase 1C, calmodulin-dependent 70kDa
  ENST ID: ENST00000396193
  CDS Start-End: 595-2904
gacttccttgtttggagtaaacttcggcaacatctcatggctgaggggtttgcctttccatctgttgatgtgctttctggaagctccccggtctgccagagaaaacatatctagaagacgcacgacgccaattcagccattcccttgggtccccaaatccccccagccaccagagacggaaggagaaggtgaagtagaaaacagactttcctgtggcgcgcgggatccgcggctgacagagagtagcgtggccaggcagggatctccgcgcccaccggtcagccccgtccacgcgctcgggcgcgcgtcctcccttcctgacactcctctcgccgcctctggaactcggcttggagatggggcagtcgcgacggctcctgcctccgccgagctcctagcgctttagctgttgacattgggtccccgctgttgtctccaggcgctcagctgccagcgcgcggcggggctgagagtgacagcgcggcgcggccgggggaggattcgccgccgagccccgggctgctcactccgccgtgggggggaccgcagacgccgctggtctcgctgcgaggcccctgcccggccggccgagccatgacggacgccggcaacaggaaggagggcttcaaaaaatgccggagcgccactttcagcatcgatggctacagcttcaccatagttgcaaatgaagctggagacaagaatgccagaccactggcccgcttctctcggtctaagtcacagaactgtctgtggaactccctcatcgatgggctcacagggaatgtcaaggagaagccaaggccaacaattgtccatgaccctcgacccccagaggagatcctagctgatgaattgccacagctggatagcccagaagtcttggtgaagacatccttcagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctggatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaaaaaaaataaaattcctctcattgccacttttttcaatctctaaaagttagttgcccccaaaagaatattggtttaataatcatcatatttaagaaatgcactgataaaaacatattttccaattttaaatacacctatttaaaatgtaaatacacttatttaaaattcaagtaaatatgtaactatcaaagtaaatgtattcaaaacagaagttgtgcttctgaatgtaaaaatattaaaaggaagagaagacggatgaattgttgtattcatggacatttcagaattcacgcttataaagcaaatccaagttaaaaaacaaaaaaagatttttgtgcctcatgaagattgtgcctcatgcccaataacctcatgtactttgaaggatgtgaaggtttgcaagagatgcatttggcttcattttcctctaatcttttacttctacccacagtagatgatacaaaaaatcttgccttaaagactgcaggtttaagagtcattgcaaaagatgtcagtttgattttgtggtcctaggccaagagggtgtaaaattctgagcctagtttaaattctttattttcagattgttctggactgaaaataaagaatttaaactaggctagagatgcctttaagttacatttcagatcctcttcacagcacgctacatatctaaagcccttgagatcctgattgttctcacagttgttggtggaatccatagttttataactcacctctttttatggtggcattgttagcccttctgtgtctctccctaggatttttaattcaggactaaaatcacagaagtagcaaggaaaggctcaagactagagatagctttcaatctcttcagaaatagcctggtgcagtgagaaaactaggtttgttttcaggccagtctgatcttcatcctattctgtctataactagttgcaggtccttgctcggatggcataattttttgatgcctccatttgcttaactagaaactaggattcatatacacactctgcactttgtattgaagattaatgataatgtaggttttggttgctgtggctgagcctggccagtaataggtgcataacagaagtagctaagagcatttcataatcaggatgaactctccaggacagccctacaaagaaggagctgtttgttcccggatggcctcgaccttccaggcttgattgtaaagagtttagtgtcctctccttctctcattccctgcagttcatttccaataaactgcagttattcaagttgagcaagttccggaatttagtgcctaccatgctattgggcagtttatttataatgtgctttatgatgatacttcagagaaatttaattgctatacaaaaagacgaatcattgtgacttttcgttaaggaggcgattgcaattctttgctccctgcctggtgtctgggttagaaggcccttctgcaggctggtagtgtctgttccacctggattaggttaactcaacaggtaattcctatctgtttatacacagatgctttagcgcttgctgtacaaagtcatttggctacacactgaggaggcccatgggagtagtagcctcctcaaataatgttccctacctatctgtcaataccttccatcttaggtattgagaatttaatgaggctgtgttttcttggctgtgcttcttgatgttggaagccatgttcctggggaacaaatctgtattcttttctcctaagatgtgagtttttttcaacctttgctaatattttaatggagcaaatgtacagatgttgagattttgcactgcttataaaatgcctaccatgttttttgcataatggattgtatagaaatgcagattatattcttacagcaaataaaaagatgcttttaacaga

SEQ ID NO: 165312 - DNA, 4315 bp, Homo sapiens
  Payload ID: 12552
  Gene Symbol: PDE2A
  Gene Name: phosphodiesterase 2A, cGMP-stimulated
  Uniprot ID: O00408
  ENST ID: ENST00000334456
  CDS Start-End: 247-3072
tgcattatcagacctgctccaacctcctcccagagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacca

SEQ ID NO: 165313 - DNA, 3355 bp, Homo sapiens
  Payload ID: 12552
  Gene Symbol: PDE2A
  Gene Name: phosphodiesterase 2A, cGMP-stimulated
  Uniprot ID: O00408
  ENST ID: ENST00000376450
  CDS Start-End: 56-2113
gacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccggttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 165314 - DNA, 1027 bp, Homo sapiens
  Payload ID: 12552
  Gene Symbol: PDE2A
  Gene Name: phosphodiesterase 2A, cGMP-stimulated
  ENST ID: ENST00000420501
  CDS Start-End: 435-1027
gaacttcctgggaagacagagtcatcaaggaaggctgtggagggtccctcagagatggaggggcttgtagtctgccatcaggaagccatagggcctgcccaggggctagaggctggactggatgatcccaagggctgctcttggaccaaccatgcccagggcatgtgacctcagggtttgcatccctcccaaccctgtttttctaacattttgtgtgggcttggtttcaagagttcttagttcttagatctctaaaaatgcatagctccgagaacggttgcttcaactattttgtggttctctagtttagatgtaagtttctaagactccagattttgagtgtggagcttgaagaaggacccaggcaagggccccgtcttgatactggcagcccctctgatacctccctctgccctctccaggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactac

SEQ ID NO: 165315 - DNA, 982 bp, Homo sapiens
  Payload ID: 12552
  Gene Symbol: PDE2A
  Gene Name: phosphodiesterase 2A, cGMP-stimulated
  ENST ID: ENST00000441209
  CDS Start-End: 1-982
ttccccaccgcctccagcgtcccggagcataagggagtcgggttccatgcctgggacgtacgtaacctgcggaaactgcgagggcaggtcccggccggatccctccctccaaccgatccctccctccaccggtggttccttgcccctctcccttccccagaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgagggtg

SEQ ID NO: 165316 - DNA, 2855 bp, Homo sapiens
  Payload ID: 12552
  Gene Symbol: PDE2A
  Gene Name: phosphodiesterase 2A, cGMP-stimulated
  ENST ID: ENST00000418754
  CDS Start-End: 202-2682
agcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctcaagccggacgagccgccgccgccgccgcagccatgcgccgacagcctgcaggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaag

SEQ ID NO: 165317 - DNA, 4193 bp, Homo sapiens
  Payload ID: 12552
  Gene Symbol: PDE2A
  Gene Name: phosphodiesterase 2A, cGMP-stimulated
  Uniprot ID: O00408
  ENST ID: ENST00000444035
  CDS Start-End: 189-2951
actcgggcggaccaggcgaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 165318 - DNA, 563 bp, Homo sapiens
  Payload ID: 12552
  Gene Symbol: PDE2A
  Gene Name: phosphodiesterase 2A, cGMP-stimulated
  ENST ID: ENST00000543750
  CDS Start-End: 85-363
actcgggcggaccaggcgaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggaaactgtctacacctacctactggatgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccag

SEQ ID NO: 165319 - DNA, 574 bp, Homo sapiens
  Payload ID: 12552
  Gene Symbol: PDE2A
  Gene Name: phosphodiesterase 2A, cGMP-stimulated
  ENST ID: ENST00000546038
  CDS Start-End: 244-363
attatcagacctgctccaacctcctcccagagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccaagtttacagcttcctgagcactgtttccacacctgtgatctcatttaatcctcaccacaaacccaagagactgctgttttctggatgaagaaacagaggatccaggaggggaaatcgcttgcccacaggcggggccagcaggtcttcctcaagccggacgagccgccgccgccgccgcagccatgcgccgacagcctgcagccagcctggacccccttgcaaaggagccaggacccccagggagtagagacgaccgact

SEQ ID NO: 165320 - DNA, 597 bp, Homo sapiens
  Payload ID: 12552
  Gene Symbol: PDE2A
  Gene Name: phosphodiesterase 2A, cGMP-stimulated
  ENST ID: ENST00000536308
  CDS Start-End: 36-356
cggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgct

SEQ ID NO: 165321 - DNA, 593 bp, Homo sapiens
  Payload ID: 12552
  Gene Symbol: PDE2A
  Gene Name: phosphodiesterase 2A, cGMP-stimulated
  ENST ID: ENST00000541998
  CDS Start-End: 51-248
gctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccggtgcactgtggccagctgagtgataatgaggaatggagcctgcaggcggtggagaagcatgtgagtgggagtggggccatgtgcaatgaggctgaagacccttatcacagctggtgggaagatggcctggccagggagctggacagacctgggtttcagcttcggctttgctgcttttg

SEQ ID NO: 165322 - DNA, 1009 bp, Homo sapiens
  Payload ID: 12552
  Gene Symbol: PDE2A
  Gene Name: phosphodiesterase 2A, cGMP-stimulated
  ENST ID: ENST00000475807
  CDS Start-End: 1-1009
cccggcctggacaggtcacgagggcggggccgggcagaacttggaggggaggtgggcgggttaggcgatcccgggagccggcggcgggcccggcgcggagctgagcggcgcctgagggacccggacacggaggtgcggaggggccctctctctgaccggcgcctggcccttgcaggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccagg

SEQ ID NO: 165323 - DNA, 543 bp, Homo sapiens
  Payload ID: 12552
  Gene Symbol: PDE2A
  Gene Name: phosphodiesterase 2A, cGMP-stimulated
  ENST ID: ENST00000535701
  CDS Start-End: 216-332
agagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcc

SEQ ID NO: 165324 - DNA, 553 bp, Homo sapiens
  Payload ID: 12552
  Gene Symbol: PDE2A
  Gene Name: phosphodiesterase 2A, cGMP-stimulated
  ENST ID: ENST00000538749
  CDS Start-End: 120-553
aagagttggtgaggaggggagctgcagagagaggggccggcagtgcagttgacggggggattcaggcggggccagcaggtcttcctcaagccggacgagccgccgccgccgccgcagccatgcgccgacagcctgcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactg

SEQ ID NO: 165325 - DNA, 639 bp, Homo sapiens
  Payload ID: 12552
  Gene Symbol: PDE2A
  Gene Name: phosphodiesterase 2A, cGMP-stimulated
  ENST ID: ENST00000542223
  CDS Start-End: 106-639
ttttcacagccaccttccttgagccccatctttccctctttcccctagtctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgat

SEQ ID NO: 165326 - DNA, 515 bp, Homo sapiens
  Payload ID: 12552
  Gene Symbol: PDE2A
  Gene Name: phosphodiesterase 2A, cGMP-stimulated
  ENST ID: ENST00000538299
  CDS Start-End: 1-515
atccgcggtcaccccctcgccctgcctgtccctctctcagctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtct

SEQ ID NO: 165327 - DNA, 3119 bp, Homo sapiens
  Payload ID: 12552
  Gene Symbol: PDE2A
  Gene Name: phosphodiesterase 2A, cGMP-stimulated
  Uniprot ID: O00408
  ENST ID: ENST00000544570
  CDS Start-End: 85-2889
actcgggcggaccaggcgaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtga

SEQ ID NO: 165328 - DNA, 544 bp, Homo sapiens
  Payload ID: 12552
  Gene Symbol: PDE2A
  Gene Name: phosphodiesterase 2A, cGMP-stimulated
  ENST ID: ENST00000543575
  CDS Start-End: 47-244
accgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccggtgcactgtggccagctgagtgataatgaggaatggagcctgcaggcggtggagaagcataccctggtcgccctgcggagggtgcaggtcctgcagcagcgcgggcccagggaggctccccgagccgtccagaa

SEQ ID NO: 165329 - DNA, 611 bp, Homo sapiens
  Payload ID: 12552
  Gene Symbol: PDE2A
  Gene Name: phosphodiesterase 2A, cGMP-stimulated
  ENST ID: ENST00000542969
  CDS Start-End: 352-611
aacctcctcccagagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctcaagccggacgagccgccgccgccgccgcagccatgcgccgacagcctgcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccg

SEQ ID NO: 165330 - DNA, 527 bp, Homo sapiens
  Payload ID: 12552
  Gene Symbol: PDE2A
  Gene Name: phosphodiesterase 2A, cGMP-stimulated
  ENST ID: ENST00000537631
  CDS Start-End: 1-226
actctggctggtggcttcagggggcaggcattctgcctttcctgtctcccaccctaagggagttggccttgcatgcctcccatccacggttgcctctactgggggctgccactgggagacaggaagggcatgggagtttcgggagctcaggccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaa

SEQ ID NO: 165331 - DNA, 3096 bp, Homo sapiens
  Payload ID: 12552
  Gene Symbol: PDE2A
  Gene Name: phosphodiesterase 2A, cGMP-stimulated
  ENST ID: ENST00000539367
  CDS Start-End: 68-265
gaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 165332 - DNA, 344 bp, Homo sapiens
  Payload ID: 12552
  Gene Symbol: PDE2A
  Gene Name: phosphodiesterase 2A, cGMP-stimulated
  ENST ID: ENST00000536458
  CDS Start-End: 67-344
gaagacatccggcatccgtaaaatggagtaatgattctgaccctgcaggttttctgggaggattaaatgagttacattttaaagatgcctggtacatgcctgccaggagaaggcacaacatatgaactccctccctcttccctccacccctcctcagctcctgtgacatcaggagggacatgccctgccctgctcacagaggctgggtgggaggctcccatcatggccttcactgaggctgcctctgcagttggaccaagctggacacacagcggggccagcaggtcttcctcaagccggacgagccgccgccgccgccgcagccatgcgccgacagcctgcag

SEQ ID NO: 165333 - DNA, 3027 bp, Homo sapiens
  Payload ID: 12552
  Gene Symbol: PDE2A
  Gene Name: phosphodiesterase 2A, cGMP-stimulated
  Uniprot ID: O00408
  ENST ID: ENST00000540345
  CDS Start-End: 141-2939
gaagaatctggaagtgcagagcttagcccctggcatgcggcaggtgctcacaaagaagtttacagcttcctgagcactgtttccacacctgtgatctcatttaatcctcaccacaaacccaagagactgctgttttctggatgaagaaacagaggatccaggaggggaaatcgcttgcccacaggcggggccagcaggtcttcctcaagccggacgagccgccgccgccgccgcagccatgcgccgacagcctgcaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgatgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaagatggctgaggtgggctacgaccgaaacaacaagcagcaccacagacttctcctctgcctcctcatgacctcctgtgacctctctgaccagaccaagggctggaagactacgagaaagatcgcggagctgatctacaaagaattcttctcccagggagacctggagaaggccatgggcaacaggccgatggagatgatggaccgggagaaggcctatatccctgagctgcaaatcagcttcatggagcacattgcaatgcccatctacaagctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtc

SEQ ID NO: 165334 - DNA, 7576 bp, Homo sapiens
  Payload ID: 12553
  Gene Symbol: PDE3A
  Gene Name: phosphodiesterase 3A, cGMP-inhibited
  Uniprot ID: Q14432
  ENST ID: ENST00000359062
  CDS Start-End: 41-3466
gggggccactgggaattcagtgaagagggcaccctataccatggcagtgcccggcgacgctgcacgagtcagggacaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcacttactctcactccccgccgcgggggtggtgctcagctgcttggccgccgcgacatggctggtgctgaggctgaggctgggcgtcctcatgatcgccttgactagcgcggtcaggaccgtgtccctcatttccttagagaggttcaaggtcgcctggagaccttacctggcgtacctggccggcgtgctggggatcctcttggccaggtacgtggaacaaatcttgccgcagtccgcggaggcggctccaagggagcatttggggtcccagctgattgctgggaccaaggaagatatcccggtgtttaagaggaggaggcggtccagctccgtcgtgtccgccgagatgtccggctgcagcagcaagtcccatcggaggacctccctgccctgtataccgagggaacagctcatggggcattcagaatgggaccacaaacgagggccaagaggatcacagtcttcaggaaccagtattactgtggacatcgccgtcatgggcgaggcccacggcctcattaccgacctcctggcagacccttctcttccaccaaacgtgtgcacatccttgagagccgtgagcaacttgctcagcacacagctcaccttccaggccattcacaagcccagagtgaatcccgtcacttcgctcagtgaaaactatacctgttctgactctgaagagagctctgaaaaagacaagcttgctattccaaagcgcctgagaaggagtttgcctcctggcttgttgagacgagtttcttccacttggaccaccaccacctcggccacaggtctacccaccttggagcctgcaccagtacggagagaccgcagcaccagcatcaaactgcaggaagcaccttcatccagtcctgattcttggaataatccagtgatgatgaccctcaccaaaagcagatcctttacttcatcctatgctatttctgcagctaaccatgtaaaggctaaaaagcaaagtcgaccaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcagctgtggcagaccatattcccaagggaatcctgctgatgagcccctggagagaagtggggtagccactcggacaccaagtagaacagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggacaaaccaattcttgctcccgaacctcttgtcatggataacctggactcaattatggagcagctaaatacttggaattttccaatttttgatttagtggaaaatataggaagaaaatgtggccgtattcttagtcaggtatcttacagactttttgaagacatgggcctctttgaagcttttaaaattccaattagggaatttatgaattattttcatgctttggagattggatatagggatattccttatcataacagaatccatgccactgatgttttacatgctgtttggtatcttactacacagcctattccaggcctctcaactgtgattaatgatcatggttcaaccagtgattcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaaaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtgacaatggatagaatgggctgtgtttccaaacagattgacttgtcaaagactctcttcaagccagcacaacatttagacacaacactgtagaaatttgagatgggcaaatggctattgcattttgggattcttcgcattttgtgtgtatatttttacagtgaggtacattgttaaaaactttttgctcaaagaagctttcacattgcaacaccagcttctaaggattttttaaggagggaatatatatgtgtgtgtgtatataagctcccacatagatacatgtaaaacatattcacacccatgcacgcacacacatacacactgaaggccacgattgctggctccacaatttagtaacatttatattaagatatatatatagtggtcactgtgatataataaatcataaaggaaaccaaatcacaaaggagatggtgtggcttagcaaggaaacagtgcaggaaatgtaggttaccaactaagcagcttttgctcttagtactgagggatgaaagttccagagcattatttgaattctgatacatcctgccaacactgtgtgtgtgtgtgtgtgtgtgtgtgtgtgtgtgtgtgtgtgtgaaagagagacagaagggaatggtttgagagggtgcttgtgtgcatgtgtgtgcatatgtaaagagatttttgtggtttaagtaactcagaatagctgtagcaaatgactgaatacatgtgaacaaacagaaggaagttcactctggagtgtctttgggaggcagccattccaaatgccctcctccatttagcttcaataaagggccttttgctgatggagggcactcaagggctgggtgagagggccacgtgtttggtattacattactgctatgcaccacttgaaggagctctatcaccagcctcaaacccgaaagactgaggcattttccagtctacttgcctaatgaatgtataggaactgtctatgagtatggatgtcactcaactaagatcaaatcaccatttaaggggatggcattctttatacctaaacacctaagagctgaagtcaggtcttttaatcaggttagaattctaaatgatgccagagaaggcttgggaaattgtacttcagcgtgatagcctgtgtcttcttaatttgctgcaaaatatgtggtagagaaagaaaaggaaacagaaaaatcactctgggttatatagcaagagatgaaggagaatatttcaacacagggtttttgtgttgacataggaaaagcctgattcttggcaactgttgtagtttgtctttcaggggtgaaggtcccactgacaacccctgttgtggtgttccacacgctgtttgttggggtagcttccatcggcagtctggcccattgtcagtcatgcttcttctggccggggagattatagagagattgtttgaagattgggttattattgaaagtctttttttttgtttgttttgttttggtttgtttgtttatctacacttgtttatgctgtgagccaaacctctatttaaaaagttgatactcactttcaatattttatttcatattattatatatgtcatgatagttatcttgatgtaaatatgaagatttttttgtttctgtagatagtaaactctttttttaaaaaaggaaaagggaaacatttttataaagttatattttaatcaccatttttatacattgtagttctctccaagcccagtaagagaatgatgattcatttgcatggaggtcgatggacaaccaatcatctaccttttctaatttaaatgataatctgatatagttttattgccagttaaatgaggatgctgcaaagcatgttttttcactagtaacttttgctaactgaatgaattctgggtccatatctcccagatgaaaaactgttaaccaataccatattttatagttggtgtccatttctttccaacactgtttgttatgattcttccttgagtacttatatacagacctgctcattatctaaacaatcttaccttctaagtaaaccttgattgtgatttccagtttttattttctctgacgtagtagaaaggaatgtttacattaaaaatacttttgtttctcataaatggatattgtactcccccctttcaaagcattattttacaataattcatggcattttaaaaaataaggcaaagataatacgacaaaaaatatacatggtttcaaggcaaattctccaataagttggaaaatgtaaaaaggatcaagtggatgcagcctctacctaaataattaaaatatatttcagtatatttctgaattaacaccaggtcttcattatttagaacttactaaattgttttcattttcttagttttacctgtgtatctccatgtttgcaaaaattactataagtcaaattttgccagtgaatttaactatttttctttccttgcaattaaggggaaaaaagcatttatcttatcttctcataccccttgcatctaagtacttagcaaagtcaatattttcccattttccaaatgcgtccatctctaacataaatattaattgaacatagagctatgtttggagtgagtggactggcaggacagttggaagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggcagattgatacatttttctttaaaaataaattgctattacagctagacgtcaattgggataaataaagggatgaagatccactaagtttgtgactttcatacacacccagtacatctcaaaggatgctaagggacattttctgccagtagagttctccccctttttggtgacagcaatattattatgttcacatctaactccagagcttacttcctgtggtgccaatgtatttgttgcaatttactacatttttatatgagcctatttataggtgccattaaactcaggtctttcaaatgaaagagtttctagcccacttagggaaaaagataattgtttagaaaaccataaaatcaatggtaggaaaagttggaactggttacctggatgccatggttctctgttaaataaagtaagagaccaggtgtattctgagtgtcatcagtgttattttcagcatgctaataaatgtctttccggttatatatctatctaaattaacctttaaaatattggtttccttgataaaagcaccacttttgcttttgttagctgtaatattttttgtcatttagataagacctggtttggctctcaataaaagatgaagacagtagctctgtacagggatatatctatattagtcttcatctgatgaatgaagaaattttctcatattatgttcaagaaagtatttacttcctaaaaatagaattcccgattctgtctattttggttgaataccagaacaaatctttccgttgcaatcccagtaaaacgaaagaaaaggaatatcttacagactgttcatattagatgtatgtagactgttaatttgcaatttccccatatttcctgcctatcttacccagataactttctttgaaggtaaaagctgtgcaaaaggcatgagactcaggcctactctttgtttaaatgatggaaaaatataaattattttctaagtaataaaagtataaaaattatcattataaataaagtctaaagtttgaaattattaatttataaaagtgaactaattgtgtgattatcaaatcctgattaatgagaagtgaataatctaaaaatcatttatattctactgtgggaggtattcttggtgcttccatgtcagtatcgggctctccattgtcctcatcatttatagtacttctaaaataataatggaaacctcaataagggtcttgtcctcttctgtcatcctaaccctgattctagtttaatgcctttcctgacttatatgccatttgtaaataaacttcctttcaaactgttagaa

SEQ ID NO: 165335 - DNA, 6076 bp, Homo sapiens
  Payload ID: 12554
  Gene Symbol: PDE3B
  Gene Name: phosphodiesterase 3B, cGMP-inhibited
  Uniprot ID: Q13370
  ENST ID: ENST00000282096
  CDS Start-End: 354-3692
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaatta

SEQ ID NO: 165336 - DNA, 3665 bp, Homo sapiens
  Payload ID: 12554
  Gene Symbol: PDE3B
  Gene Name: phosphodiesterase 3B, cGMP-inhibited
  Uniprot ID: Q13370
  ENST ID: ENST00000455098
  CDS Start-End: 246-3431
gaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaaggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgt

SEQ ID NO: 165337 - DNA, 2583 bp, Homo sapiens
  Payload ID: 12555
  Gene Symbol: PDE4A
  Gene Name: phosphodiesterase 4A, cAMP-specific
  Uniprot ID: P27815
  ENST ID: ENST00000293683
  CDS Start-End: 1-2583
atggcgcggccgcgcggcctaggccgcatcccggagctgcaactggtggccttcccggtggcggtggcggctgaggacgaggcgttcctgcccgagcccctggccccgcgcgcgccccgccgcccgcgttcgccgccctcctcgcccgtcttcttcgccagcccgtccccaactttccgcagacgccttcggcttctccgcagctgccaggatttgggccgccaggcttgggctggggctggcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctga

SEQ ID NO: 165338 - DNA, 2579 bp, Homo sapiens
  Payload ID: 12555
  Gene Symbol: PDE4A
  Gene Name: phosphodiesterase 4A, cAMP-specific
  Uniprot ID: P27815
  ENST ID: ENST00000344979
  CDS Start-End: 326-2269
cgggtgcacacacagagctccgcagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacaca

SEQ ID NO: 165339 - DNA, 4781 bp, Homo sapiens
  Payload ID: 12555
  Gene Symbol: PDE4A
  Gene Name: phosphodiesterase 4A, cAMP-specific
  Uniprot ID: P27815
  ENST ID: ENST00000380702
  CDS Start-End: 111-2771
cgcggccgggcgcacccgcggggccctgggctcgctggcttgcgcgcagctgagcggggtgtaggttggaagggccagggccccctggggcgcaagtgggggccggcgccatggaacccccgaccgtcccctcggaaaggagcctgtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcgcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgat

SEQ ID NO: 165340 - DNA, 2478 bp, Homo sapiens
  Payload ID: 12555
  Gene Symbol: PDE4A
  Gene Name: phosphodiesterase 4A, cAMP-specific
  Uniprot ID: P27815
  ENST ID: ENST00000440014
  CDS Start-End: 1-2478
atgcgctccggtgcagcgccccgggcccggccccggccccctgccctggcactgccccccacgggccccgagtccctgacccacttccccttcagcgatgaggacacccgtcggcaccctccgggcagatctgtcagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctga

SEQ ID NO: 165341 - DNA, 1703 bp, Homo sapiens
  Payload ID: 12555
  Gene Symbol: PDE4A
  Gene Name: phosphodiesterase 4A, cAMP-specific
  ENST ID: ENST00000589073
  CDS Start-End: 308-598
tccgcagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctgggcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgggcggggctggggcgggacggagcgggaaaggaagcctaggagtcgagggctttggggaggagtgggtctgagtcccagaggaaccctcaacctggacagagcgggcggcttctacctggtgaaaacttcagaggcccgggtcagtctggggggcgggtgtcagcggccccagtgacgcccccttgcccgcaggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaatt

SEQ ID NO: 165342 - DNA, 836 bp, Homo sapiens
  Payload ID: 12555
  Gene Symbol: PDE4A
  Gene Name: phosphodiesterase 4A, cAMP-specific
  ENST ID: ENST00000591971
  CDS Start-End: 1-836
gaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagac

SEQ ID NO: 165343 - DNA, 2707 bp, Homo sapiens
  Payload ID: 12555
  Gene Symbol: PDE4A
  Gene Name: phosphodiesterase 4A, cAMP-specific
  Uniprot ID: P27815
  ENST ID: ENST00000592685
  CDS Start-End: 85-2679
cgtcacgccccaggagaggcaataggaggccctggccctgccgacatggccaccgcagtcccaacggcgcgctaggttggcgagatgaagaggagtcgcagtgccctgtccgtggcagggaccggggacgagaggtcgagggagacccccgaatccgaccgtgccaacatgctgggggccgacctgcgtcgccctcgccgccgcctctcgtccggtcctggcctgggctgggcccagcctgagccctcggaccctggggtccctctgccgccacggcccaccaccctgccgctgctgatcccaccgcggatttccatcaccagggccgagaacgacagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctc

SEQ ID NO: 165344 - DNA, 3998 bp, Homo sapiens
  Payload ID: 12556
  Gene Symbol: PDE4B
  Gene Name: phosphodiesterase 4B, cAMP-specific
  Uniprot ID: Q07343
  ENST ID: ENST00000329654
  CDS Start-End: 188-2398
gtaatccttcagctctggtggtaagggagatgcagtgagctcccggctgggagagagggttattttgcaaaactcccctggtaccgtgcccgcggaatattgcaggaggtctgtgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaa

SEQ ID NO: 165345 - DNA, 3175 bp, Homo sapiens
  Payload ID: 12556
  Gene Symbol: PDE4B
  Gene Name: phosphodiesterase 4B, cAMP-specific
  Uniprot ID: Q07343
  ENST ID: ENST00000341517
  CDS Start-End: 139-2349
gcggccgcggcggtgcagcagaggcgcctcgggcaggaggagggcggcttctgcgagggcagcctgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgc

SEQ ID NO: 165346 - DNA, 3982 bp, Homo sapiens
  Payload ID: 12556
  Gene Symbol: PDE4B
  Gene Name: phosphodiesterase 4B, cAMP-specific
  Uniprot ID: Q07343
  ENST ID: ENST00000371045
  CDS Start-End: 387-2081
aaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattagatta

SEQ ID NO: 165347 - DNA, 4546 bp, Homo sapiens
  Payload ID: 12556
  Gene Symbol: PDE4B
  Gene Name: phosphodiesterase 4B, cAMP-specific
  Uniprot ID: Q07343
  ENST ID: ENST00000423207
  CDS Start-End: 486-2651
cacatgctggacggattctgggtctgctctttgtgcaaacaaaacaagtgactaggttttgcttactatccattagtgaatgcagcttgtttaataagattttttttaaaaaaatgcatgtaaaggatttatcaaaagcctttatgaatatttcatgagttgatatattcagctgaatgaattcagtgagtgtcagtgtgtagcttgcagacaaacctcatccacaaggaggctactgacattggaagcactttggcgcattttcagaggcaaagccagcctgataaagctccttgtgacagcctgacttgctattcttcgagtatgctgctcttgctctaagacgctcatacattggagtcacagcttcgtaaattaaactggaaatagtttgcagacttatcagtcttctgacctgcagcagtgtctctgctatgtttgagatttttgttttggatggtgaaagctagcactccttacaagacatgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttgctggtgaataaaagcattcggcagcgtcgtcgcttcactgtggctcatacatgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgatt

SEQ ID NO: 165348 - DNA, 579 bp, Homo sapiens
  Payload ID: 12556
  Gene Symbol: PDE4B
  Gene Name: phosphodiesterase 4B, cAMP-specific
  ENST ID: ENST00000412480
  CDS Start-End: 139-579
acaagatgaagatgagcaggcagggtggcagcactggctgtggcagcagcagcacaccaccacctatgcaaggtctgtactttttaacacagcattggaagccagtatcagtcatggttctccagagaaacagaactgatgagctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctac

SEQ ID NO: 165349 - DNA, 546 bp, Homo sapiens
  Payload ID: 12556
  Gene Symbol: PDE4B
  Gene Name: phosphodiesterase 4B, cAMP-specific
  ENST ID: ENST00000528771
  CDS Start-End: 136-546
ctggaagcaaacagaggaggcaaggggttgtttcggacacactagagagtaagtcagagaatcttcgtgttgaggcagcattgcaaaattgaagatgaagaaaggaaggaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggct

SEQ ID NO: 165350 - DNA, 226 bp, Homo sapiens
  Payload ID: 12556
  Gene Symbol: PDE4B
  Gene Name: phosphodiesterase 4B, cAMP-specific
  ENST ID: ENST00000491340
  CDS Start-End: 1-199
acacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaaggtaggccatgtcataaggtctatctagatgtttcaagatagaataataaacatgcctcttattcagaa

SEQ ID NO: 165351 - DNA, 2037 bp, Homo sapiens
  Payload ID: 12556
  Gene Symbol: PDE4B
  Gene Name: phosphodiesterase 4B, cAMP-specific
  Uniprot ID: Q07343
  ENST ID: ENST00000480109
  CDS Start-End: 466-1977
attttaatcttctcctttttaaaagatggctgtgtttcctagtctggcaactcctcaggaaagaagaatttcttcttccttgcagagttcagctgagtaggactaatgtagaagagtggaaaccccttcggccaccagggctattcataattcataagtgcttcaaaccagccagctgaatacatttggacaggctcttgctccttcgtgcaattcctgatttcattactctcttctgccaggaaataagcagggagcataggcttcttgcaagaatggagtgcgaagatgggctttgtttggcttaggaaatgccatacattttggaggtttttgtcttttctaagttttgattattttatcactgaatctgcagggctttcctgatcctttcgggattgctctctcagaactgtgaattctttcaaagggatttgtggattgtggcaaggagagcattccaaaatgcctgaggcaaattatttgttatctgtatcttggggttacatcaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggta

SEQ ID NO: 165352 - DNA, 550 bp, Homo sapiens
  Payload ID: 12556
  Gene Symbol: PDE4B
  Gene Name: phosphodiesterase 4B, cAMP-specific
  ENST ID: ENST00000526197
  CDS Start-End: 95-550
aggacacatttatgcagatgagcttataagagaccgttccctccgccttcttcctcagaggaagtttcttgaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctata

SEQ ID NO: 165353 - DNA, 561 bp, Homo sapiens
  Payload ID: 12556
  Gene Symbol: PDE4B
  Gene Name: phosphodiesterase 4B, cAMP-specific
  ENST ID: ENST00000531025
  CDS Start-End: 132-561
gagtctgagaaaactctttggtgcttctgcctttagttttaggacacatttatgcagatgagcttataagagaccgttccctccgccttcttcctcagaggaagtttcttgaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagac

SEQ ID NO: 165354 - DNA, 2472 bp, Homo sapiens
  Payload ID: 12557
  Gene Symbol: PDE4C
  Gene Name: phosphodiesterase 4C, cAMP-specific
  Uniprot ID: Q08493
  ENST ID: ENST00000262805
  CDS Start-End: 61-2103
gctgtccagaaaaggtcccgcgcagccggcgctcggtccagcctccacgcagtcctggcgatgcagggcccccccgcgcccgccccggtccccgggcccggctcccctcggggatccccgcgcggctcccccgggctcttcaggaagcttttggtgaatcagagcatccgcctgcagcggcgcttcacggtggcccatccgctgtgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaa

SEQ ID NO: 165355 - DNA, 5979 bp, Homo sapiens
  Payload ID: 12557
  Gene Symbol: PDE4C
  Gene Name: phosphodiesterase 4C, cAMP-specific
  Uniprot ID: Q08493
  ENST ID: ENST00000355502
  CDS Start-End: 873-3011
ccccgcgctccgccagcagggagcgcacacgcaggtgcaaggagctggcacctgggcacacacctggccacacacctgtgcagagccggtggcaggccctcccggcgcaggaatggcgtgcccccagctgccgccacttctgcttttggtgctggtggtgctgctgaaagctggtgtgaattacaatactccctttacagttccgaatccctgaccccgcactggagccccacttcccacagccccggaacggagcccttgacctccactgaccagaccttggagccccctggcccagctccaggtgacactgggccccgtgagttacacaggaacccgagtgtggtggtggtcgtgtgtttgctggtgtctcttttgctcatcgggtctgtggtcatggctgtgagattctgtcaccggaatgagtccaagtttgagaacctggacgaggtgtccatgtggttctgggagttggtggattctggcttggcccctgtgagcccccttggtggtggtatcatccggagaggcttctcgggtaccccattgctgccatcgctgccgagccgccttgtgttgcctggagaggtcgagcccagtacccatgtggtgttcaccattgaggcttaagggacagagaaaagacagcgtggtcccagatagcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaattgagtgtcctggccatttcactgatgaggaaactgaggcgcagagaggtcctcttgccagctcaaagtcaagcatctgggcgcccaatgttagccagcggcaccccctggtggcgggcgtgggagacacggcggggcgcgcttgtcgggggttggggggtgggtcggaggggtggcatcctccagccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccaccca

SEQ ID NO: 165356 - DNA, 2542 bp, Homo sapiens
  Payload ID: 12557
  Gene Symbol: PDE4C
  Gene Name: phosphodiesterase 4C, cAMP-specific
  Uniprot ID: Q08493
  ENST ID: ENST00000447275
  CDS Start-End: 336-2156
ttcgacgtgatcagacccaactcagacccggtcatacttggaccgaatgctgccaaatcccccacctctacccagatctgagcctacgcggggtgccgacccagctcgtggacggggatacggtgacctttgacccaaaagtcttggccgggaccagccggacactggccctcggccgggagctccgagtctcaggcggtcccggttgtcttcctgtcggtgccgcttccgcctgcccttcttgaaaacccacccccagctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatcta

SEQ ID NO: 165357 - DNA, 1699 bp, Homo sapiens
  Payload ID: 12557
  Gene Symbol: PDE4C
  Gene Name: phosphodiesterase 4C, cAMP-specific
  ENST ID: ENST00000539010
  CDS Start-End: 156-1601
gaccgttcggagcaacgtggcggcccttgcccgccagcaatgcctaggagcagccaaaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgctt

SEQ ID NO: 165358 - DNA, 4655 bp, Homo sapiens
  Payload ID: 12557
  Gene Symbol: PDE4C
  Gene Name: phosphodiesterase 4C, cAMP-specific
  Uniprot ID: Q08493
  ENST ID: ENST00000594617
  CDS Start-End: 240-2378
atgggacccaggcaggactccgcagtggtgcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaag

SEQ ID NO: 165359 - DNA, 2988 bp, Homo sapiens
  Payload ID: 12557
  Gene Symbol: PDE4C
  Gene Name: phosphodiesterase 4C, cAMP-specific
  Uniprot ID: Q08493
  ENST ID: ENST00000594465
  CDS Start-End: 481-2619
aaagctacctttttctctttcaacacggtgcgagggacaccgtctcggccccgggggtctcctgagaccctgtctccctgccctccatttagcagcgatcagtggacaatttctgtcttctccactccaagtccttgtcttggttcttttccatgcagcgctataggggacggcagacggttttcggggctggtgtgttgggggggggtctcttcagcccctagcttcaacaccccctcaccacgttcttctcccctgttctacccttcagcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaa

SEQ ID NO: 165360 - DNA, 528 bp, Homo sapiens
  Payload ID: 12557
  Gene Symbol: PDE4C
  Gene Name: phosphodiesterase 4C, cAMP-specific
  ENST ID: ENST00000599754
  CDS Start-End: 249-528
agagatactcctcctgcctgtcctgagcttccacaaaagcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggaggg

SEQ ID NO: 165361 - DNA, 2101 bp, Homo sapiens
  Payload ID: 12557
  Gene Symbol: PDE4C
  Gene Name: phosphodiesterase 4C, cAMP-specific
  ENST ID: ENST00000599188
  CDS Start-End: 11-706
agtcctggcgatgcagggcccccccgcgcccgccccggtccccgggcccggctcccctcggggatccccgcgcggctcccccgggctcttcaggaagcttttggtgaatcagagcatccgcctgcagcggcgcttcacggtggcccatccgctgtgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaaaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgctt

SEQ ID NO: 165362 - DNA, 420 bp, Homo sapiens
  Payload ID: 12557
  Gene Symbol: PDE4C
  Gene Name: phosphodiesterase 4C, cAMP-specific
  ENST ID: ENST00000595343
  CDS Start-End: 1-35
ttgcccgccagcaatgcctaggagcagccaaatgaggaggctgaggcccagagatctcatggtcacacaggcactcggggaacagatctggaacttgggtccaggagtcctgggtggcccccgtgggaacagtttcagggtccagatgaagagacgaagtcgcgagaggcgtggggtccctgagcgggggggttgggcaggcccctgactgcctcggctcccagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccg

SEQ ID NO: 165363 - DNA, 1284 bp, Homo sapiens
  Payload ID: 12557
  Gene Symbol: PDE4C
  Gene Name: phosphodiesterase 4C, cAMP-specific
  ENST ID: ENST00000598111
  CDS Start-End: 1-1284
atgcctaggagcagccaattcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttag

SEQ ID NO: 165364 - DNA, 481 bp, Homo sapiens
  Payload ID: 12557
  Gene Symbol: PDE4C
  Gene Name: phosphodiesterase 4C, cAMP-specific
  ENST ID: ENST00000593594
  CDS Start-End: 1-269
ttgcccgccagcaatgcctaggagcagccaaccccgcccctgcaaaaacaataacgccctcggggatggaccccaccacactcatattacagatgaggaggctgaggcccagagatctcatggtcacacaggcactcggggaacagatctggaacttgggtccaggagtcctgggtggcccccgtgggaacagtttcagggtccagatgaagagacgaagtcgcgagaggcgtggggtccctgagcgggggggttgggcaggcccctgactgcctcggctcccagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccg

SEQ ID NO: 165365 - DNA, 1559 bp, Homo sapiens
  Payload ID: 12557
  Gene Symbol: PDE4C
  Gene Name: phosphodiesterase 4C, cAMP-specific
  ENST ID: ENST00000597297
  CDS Start-End: 111-1559
accccctccggatccggcctctccttcccaccgcctaccacctcctcccaacaggtcctggccagtctgcggaccgttcggagcaacgtggcggcccttgcccgccagcaatgcctaggagcagccaattcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttag

SEQ ID NO: 165366 - DNA, 583 bp, Homo sapiens
  Payload ID: 12557
  Gene Symbol: PDE4C
  Gene Name: phosphodiesterase 4C, cAMP-specific
  ENST ID: ENST00000610023
  CDS Start-End: 338-583
ggaagacctgaattgagggggttttcgaggcagggcgttcgggagtcccaggctgagcgcgcgcctgcgcccggcagctgcttgcgctgcatcctctaagcactcggtccacccctctgggttcgaatccctgcctttccagaaacgactgtgacctcgtggggagggatgggggcaaggctggggttcggagtggggcttgtgggcgccgactgtggctggcatcctgcgcttggtccgcgccgaattggcacccacttgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaac

SEQ ID NO: 165367 - DNA, 5676 bp, Homo sapiens
  Payload ID: 12558
  Gene Symbol: PDE4DIP
  Gene Name: phosphodiesterase 4D interacting protein
  ENST ID: ENST00000313431
  CDS Start-End: 658-4056
ggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaactatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccat

SEQ ID NO: 165368 - DNA, 1137 bp, Homo sapiens
  Payload ID: 12558
  Gene Symbol: PDE4DIP
  Gene Name: phosphodiesterase 4D interacting protein
  Uniprot ID: Q5VU43
  ENST ID: ENST00000369347
  CDS Start-End: 179-700
ccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatagattcacttattcagcaaacatttactgggcatgccacatgccagataccgggctaagtatctggcatgtgttacagaaacaaaagacctaattcttgtcaccaagaaacatgttacatgattttaataagttccctgatagaagagcatggggtgctctggggaaatattggagggtcatccattccacattaaaagagcaagttgtctgct

SEQ ID NO: 165369 - DNA, 4677 bp, Homo sapiens
  Payload ID: 12558
  Gene Symbol: PDE4DIP
  Gene Name: phosphodiesterase 4D interacting protein
  ENST ID: ENST00000369349
  CDS Start-End: 146-3055
aggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaactatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataa

SEQ ID NO: 165370 - DNA, 4922 bp, Homo sapiens
  Payload ID: 12558
  Gene Symbol: PDE4DIP
  Gene Name: phosphodiesterase 4D interacting protein
  ENST ID: ENST00000369351
  CDS Start-End: 110-3076
gcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaagtaagtcagtgtcagggtctgggacttccagggtggacagcacacagcccttctgaggtctgatagtctcctgcagcccttgcggacttagtgagaagatatctttttacataaactacttctcagtcatcttcctgttctccttgaacttcccagctgcctttccaacccatatcttcactccatttttctctccaatccaccctttggtttgtattgtatctctttcttctgcttccttccccctcctacccacctttgcccctatttattctctgtagctatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataa

SEQ ID NO: 165371 - DNA, 8262 bp, Homo sapiens
  Payload ID: 12558
  Gene Symbol: PDE4DIP
  Gene Name: phosphodiesterase 4D interacting protein
  ENST ID: ENST00000369354
  CDS Start-End: 191-7231
agagcagtgagcccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggagcagttcatcgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaaaatgtgtataaagaaataaatagtttttctttca

SEQ ID NO: 165372 - DNA, 8307 bp, Homo sapiens
  Payload ID: 12558
  Gene Symbol: PDE4DIP
  Gene Name: phosphodiesterase 4D interacting protein
  ENST ID: ENST00000369356
  CDS Start-End: 292-7380
acaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggagcagttcatcgtcagccagctaaccagaacacatgatgttttaaagaaggcaaggactaacttagaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaaaatgtgtataaagaaataaatagtttttctttca

SEQ ID NO: 165373 - DNA, 670 bp, Homo sapiens
  Payload ID: 12558
  Gene Symbol: PDE4DIP
  Gene Name: phosphodiesterase 4D interacting protein
  ENST ID: ENST00000491426
  CDS Start-End: 1-287
aagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaaccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataa

SEQ ID NO: 165374 - DNA, 597 bp, Homo sapiens
  Payload ID: 12558
  Gene Symbol: PDE4DIP
  Gene Name: phosphodiesterase 4D interacting protein
  ENST ID: ENST00000528129
  CDS Start-End: 56-211
agcagagtcctggcttggagtcgggttacaccacttgtgtctgagttcacgcagcatgttcctctgtcagggattccgcaaatatctccctgagcacctcaatgacctgaagaaggagaacttcagcctcaagctgcgcatctacttcctggaggagcgcatgcaacagaagtatgaggccagccgggaggacatctacaagcggggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagt

SEQ ID NO: 165375 - DNA, 927 bp, Homo sapiens
  Payload ID: 12558
  Gene Symbol: PDE4DIP
  Gene Name: phosphodiesterase 4D interacting protein
  ENST ID: ENST00000530130
  CDS Start-End: 1-927
tggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagc

SEQ ID NO: 165376 - DNA, 8824 bp, Homo sapiens
  Payload ID: 12558
  Gene Symbol: PDE4DIP
  Gene Name: phosphodiesterase 4D interacting protein
  ENST ID: ENST00000529945
  CDS Start-End: 441-3791
agacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtggggaactggaaagtgtgcgaattcatcacaagcatgcctactgagcactggcgggtcagactgcagcccaggatggaaaaccttgtttgcactaaccagaaagatccttgtctgattttggcagaattaaacggtgacttactaatgatagaactggtacaagtagcatcaactacaaagtgaaactcactttagcctacatggatctcactgtacatacatatcaatccctaaattgaatggtggaggttgcaaagtgtatttgcacattttaaatcattctgttttagtttttccacttttattcattcttatccctagccccttctcgttccctcatcccttctgtgggccaataaagtttattcttccccaactttcacaatccatttcatatgttccatatcatatcataaatgcatgtgtgtgtattatttttgccattcagtcaactcctctttgagtgagagcattttttaaatcaaaagcatgcaagttttaagatgagagagcgggaaagagattgagagtctataagaatgactttgcaaaagtgatataatccttatcagaaggtaatcaaaaccaggagagtagtcttgtaatagtagactgcaagtattgggaaggccaagttaaagaacagaggcaagaactatgaaagtgatcatagtcaacttttatctccaatactgtctcagagttgactgttgtacacaagtgaaattagattaggtacagattaaattctacttaaaatttgttctttattgattcctttaggtttctttaaaccaagctcatgctatttagtcagaacatgacttctagaatggtcttccagagtcagaattctctgtttacaaagataatttcaaatgtagtatccctctttacattcagtgtttcaccaaataactcattatagccagaagagggtattgcttctttcatttgtggcactagatagggtcctatgtttttcactatttagtatgtatacatttctccatataacagtaataggcttcaggctttgaagtgctagaatagtttagaaagaaatgttacagatgtatgtttatagttttaatcattgcctcagtgctttcttgtggcagcgtgacaggtataaggagaggggcactggagattgtatttctgatgtcttgaatgtcaagtgtgaaaagtaaccaagattgctttgcagctttgtgagatcaacatcatgaatttgttttcatttcctctggttggaagtttcctaggttagaagctgaggtttcagttactttaaatatggaatttgggaacagggattgaggctttctagcacagtaaatgtgactgaataccctttctaaactaagtggggcacaatgattttttttccttccattttttttttacatgacactttatttctttcacatgttgacatggcttgtattacattctaaatttcatctgtttctgtaactttagctgtgtctataacagatagagcatcagtcaaactagagtggacagggagaaaatgctctactggggaagcactctggaatcttctgattaagtcatttgcaaaagattaatagccataagccttactcttaatggatctgccatttcagtttcaatggcttttgaggaaaaaggagtcatttaaggaaggagataggaagtgtaggccgatccatccacttttcttagtctcccaattttaagagaccctttcttgcacaaaattttttgtaactttccataagtaaagaggaaggtaatggagccgtagaaatgtcaacccatcaaagactagtttgtcgtgtcattacaacaaggcatttagggaacatctttccttaattttactaatagaccaaccaaggaagccttctgaatcgctagtaagattcagctctgggtgattcttcatttctaatggctcatagtgattacagtttatgttaataatcactcctacttctgtcaacctccagcaagagtaaattgatagcaggataaattaaaagtctgatcttaatgtcataaatgtgactagaatatggtactaactttttcgggtctagatagctggaatgaggcttgcaaacagtgttatctggagagagcttgctggtctaacaactttgtgtgataatttggcatctgattagagagcatgagtctgataaattttataatccacacagagatcatgctgtggttggacacatcatttaataatatttagcatgatataatattccattttctctacaggagcacagactctttctcatactggattattttacctttgacagtcatttttcaatgacagtaattttaaataaagcatcgtgtgcttatagaacctgtgcttgagtaaaaatagtcttcaaataaaaataatgaagtaaatttttacttaggccatgcttaattggaagcatagaacttaaattgagaaaaaaatccatatgatagattttgtttttctcatgcttcccttttgaataatagcaaataatgcagagtaatggttctaagagttcagggtagatgaagtctgtaggttttagaagtatagagttgaaaagaacctccaagaggacttatttaatgagtgaaataaatgtccttagatagatattgtccctaaactcttttctattgaaagtttatagtattgaaaatttgatgattattagtacctagtataaatcaacattcatctgatgttctctttttagatagccaagttataacttttttgaaaagacattattggactaagttagtaggtcagccttttcctttgatagtgtgtactcttatctgtcacccaaccttctccacaccctcttctcttcattcagttgtggacagcagtaattttttcaggacctttgcttcttagaggaaatacatttttccttatttatatttttaaaagatgtttctattacattatatatagcaagagatctattaaggatccagaaaatcttaacctgtagaggatatgagttcctcatcataagaattagtttccttgagggttctttagtatattctatttacacagtttatgcataagtaaactctgtggccgatgtacataaaaaaacctatcacttttatgctcattcatcctcctaattcagtgtctgggtcatgagatgtttggttcatagcttcaaaaactgttcaagaagactgatttcagttctctctatgttgatcttccagttgaatctggagtcttctgattgtggaaaggagtagcagatcacattatactgaaaattgtccttttcattgagaaataaaggttgactgagctacctaaagtcactttcctttggactgtaagccttagagagaacaataatacctttgcttttcttgaggtagtattagaaaactctagttcccattgataggataaacttgttttctcgtttcatggtctttttatagaaaacagtcacaaaatcttgacatttggcatccctgaaaagctcaagtggccttttcaagtagggtatcatgtagtattctgcaggtttacagtcagtatcctgcaaggaaaggtgacaaacttcctgtgaagttaggaagaaatattagtaacccacacacttgaagtgagttttccattttaccttgtagaaattgtactagagatagaacaaatgaaattagttttcttttccaggtatatcctgtgagataccagcacagagtattttctctgagttctctcagggttaaagctcagtgagcttttcttttctctttggtagtgtggaaccatttgtaccgtagaaagaatagctggaaatatggaactccaatgtggcaatacagtaataaacagaaggaatgagtcagtaggataatatattcgagtgatttctgtatatttcagttataatgttttttatatagtgtatatttcagttatttcagttataatgtgttttagaatgtggatttaagccaccttctcaccctttgcaccagtagctttgttaaaacattttattatgatcaaataacaagcctgttgcttttaagtaatctaagtattaacagaaggtaagtcttcaacttctccctgttctcacctgggccaagatcaattttctaaataaaaaatagctttgtaatttgtctccaacaaagaatgggaaatggaagggaacacaaaactgtggtcctgacaatactaattctacccgttttcaaataagaataattaaacttataaagtgatatactgattatttttgtgttactctcccttttttttgtttaaagtcaaattccagaagtaaaaatctttatcatactgttttcctcttactaaaactggaagggtaaaatagaaagttcagcaacatcagaaaatgttgtatttaaaataatatggagaataggggttttaagtacataaaccatattggcttccttgtaggtttacttttagtatataacatgaatatgtagtgcttctttttacaataatcaaagtcatagctccaagatattgacctctttctcaatctataacctttgtaggcatgcatttataccagcatgttttataaattatgagtttctatctgtgtccatgaagtcttactagttttcacttaaacttttgtgggttgttaagaagaattaaagtgattcataacttcacgcttgaacctgggaggtggaggttgcagtgagccgagatcatgccattgcactccagcctgggcaacaagagtgaaactctgtcttaaataaataaataaagtggttcataacatcagatgaagaaggaggtgagtgatatgttaaatgatcagaaacttggcattacattatttccaggaccatttccctaccaaagctgtgtatttttcatttcttcatggcactgtgctgttaatttctgttaacatttgtgctaaaatggagtgtaatttttacatataagtgttagaattttagctatcttagttgaaacacaaaaagttgttactgatccaataaaattatcaaaggccaacagaaa

SEQ ID NO: 165377 - DNA, 704 bp, Homo sapiens
  Payload ID: 12558
  Gene Symbol: PDE4DIP
  Gene Name: phosphodiesterase 4D interacting protein
  ENST ID: ENST00000526445
  CDS Start-End: 195-341
acccagagcagtgagcccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcct

SEQ ID NO: 165378 - DNA, 647 bp, Homo sapiens
  Payload ID: 12558
  Gene Symbol: PDE4DIP
  Gene Name: phosphodiesterase 4D interacting protein
  ENST ID: ENST00000534536
  CDS Start-End: 89-647
acagttgggcctgggaggctccaggagggtgacagcagagtcctggcttggagtcgggttacaccacttgtgtctgagttcacgcagcatgttcctctgtcagggattccgcaaatatctccctgagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctg

SEQ ID NO: 165379 - DNA, 1076 bp, Homo sapiens
  Payload ID: 12558
  Gene Symbol: PDE4DIP
  Gene Name: phosphodiesterase 4D interacting protein
  ENST ID: ENST00000530062
  CDS Start-End: 1-262
agtagatgaacggagtcggctcaatgaggccttacaagcagagagacagctctatagcagtctggtgaagttccatgcccatccagagagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggagcagttcatcgtcagccagcgtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagctt

SEQ ID NO: 165380 - DNA, 2746 bp, Homo sapiens
  Payload ID: 12558
  Gene Symbol: PDE4DIP
  Gene Name: phosphodiesterase 4D interacting protein
  ENST ID: ENST00000479408
  CDS Start-End: 222-2444
agaacccaggcggggcggggccgggaaaggtgaggctgctggcgggaagcgggggcggcgcgcagcggtacctagcggcgctgccccgctggcagccggaggacgtggcactgtccgagaatgcagggaggggattcgtctttctcctccccgcgaggaggagcctcgacatcctgcagaggcgggaggatccttgagggcactggtgcgactttcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtggggaactggaaagtgtgcgaattcatcacaagcatgcctactgagcactggcgggtcagactgcagcccaggatggaaaaccttgtttgcactaaccagaaagatccttgtctgattttggcagaattaaacggtgacttactaatgatagaactggtacaagtagcatcaactacaaagtgaaactcactttagcctacatggatctcactgtacatacatatcaatccctaaattgaatggtggaggttgcaaagtgtatttgcacattttaaatcattctgttttagtttttccacttttattcattcttatccctagccccttctcgttccctcatcccttc

SEQ ID NO: 165381 - DNA, 578 bp, Homo sapiens
  Payload ID: 12558
  Gene Symbol: PDE4DIP
  Gene Name: phosphodiesterase 4D interacting protein
  ENST ID: ENST00000533259
  CDS Start-End: 342-578
gagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggctagcaaagaatgaagctgcgcggatggcagctctggtggaagcagagaaggagtgtaacctggagctctcagagaaactgaagggagtcaccaaaaactgggaagatgtaccagga

SEQ ID NO: 165382 - DNA, 8439 bp, Homo sapiens
  Payload ID: 12558
  Gene Symbol: PDE4DIP
  Gene Name: phosphodiesterase 4D interacting protein
  ENST ID: ENST00000585156
  CDS Start-End: 21-7469
tggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttagtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggagcagttcatcgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatga

SEQ ID NO: 165383 - DNA, 8150 bp, Homo sapiens
  Payload ID: 12558
  Gene Symbol: PDE4DIP
  Gene Name: phosphodiesterase 4D interacting protein
  ENST ID: ENST00000618462
  CDS Start-End: 394-7116
gctcgcggttgacagctcagctggtgccgagcaactcgtgccagccagtcgtgtctcagcctggagagtgcgcgcaccgcggcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgagttggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggagcagttcatcgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaaaatgtgtataaagaaataaatagtttttctttcactg

SEQ ID NO: 165384 - DNA, 823 bp, Homo sapiens
  Payload ID: 12558
  Gene Symbol: PDE4DIP
  Gene Name: phosphodiesterase 4D interacting protein
  ENST ID: ENST00000620605
  CDS Start-End: 28-687
actggggtggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggcaattgcctacccaaaccctaggcccagccgactttggaggtctccagttgaaccttcaccttttactggaatggagcagtctctgcaagaggggttggtggaagtaggaagcaaaaaaattgagaaaagaaacagtaagaagaggaagttcttgcagggagaattgtttttcaagagagctatatttttattttgaacagcatccatttgtttgataaatatatcattatcttctgtgtgtgg

SEQ ID NO: 165385 - DNA, 569 bp, Homo sapiens
  Payload ID: 12558
  Gene Symbol: PDE4DIP
  Gene Name: phosphodiesterase 4D interacting protein
  ENST ID: ENST00000613995
  CDS Start-End: 140-569
atggagaaggaaagagatcagggcaccacactgctcaggctttattgaggccaggcaacagttggcttttaggtcagattttggagatggcctgtgaaactgcgttttcttccagtccttcccccagacacactttaaaatgaagccccattcaaggaaaggagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtgg

SEQ ID NO: 165386 - DNA, 567 bp, Homo sapiens
  Payload ID: 12558
  Gene Symbol: PDE4DIP
  Gene Name: phosphodiesterase 4D interacting protein
  ENST ID: ENST00000618504
  CDS Start-End: 178-426
attttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaaggtaagtcatgtgagtggataattgttatcccaattagaagcagtactatggaatagtgatgcctgataaaaatatgacccatggattggtccggattatggatggtattatcattatggtgtctctttcaagagcatgtcccaataaacatatgctctgtca

SEQ ID NO: 165387 - DNA, 685 bp, Homo sapiens
  Payload ID: 12558
  Gene Symbol: PDE4DIP
  Gene Name: phosphodiesterase 4D interacting protein
  ENST ID: ENST00000619981
  CDS Start-End: 184-528
aaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggca

SEQ ID NO: 165388 - DNA, 8305 bp, Homo sapiens
  Payload ID: 12558
  Gene Symbol: PDE4DIP
  Gene Name: phosphodiesterase 4D interacting protein
  ENST ID: ENST00000524974
  CDS Start-End: 40-7335
accgtagctaggactggggtggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttagtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggagcagttcatcgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatga

SEQ ID NO: 165389 - DNA, 1055 bp, Homo sapiens
  Payload ID: 12558
  Gene Symbol: PDE4DIP
  Gene Name: phosphodiesterase 4D interacting protein
  ENST ID: ENST00000464103
  CDS Start-End: 89-619
acagttgggcctgggaggctccaggagggtgacagcagagtcctggcttggagtcgggttacaccacttgtgtctgagttcacgcagcatgttcctctgtcagggattccgcaaatatctccctgagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatagattcacttattcagcaaacatttactgggcatgccacatgccagataccgggctaagtatctggcatgtgttacagaaacaaaagacctaattcttgtcaccaagaaacatgttacatgattttaataagttccctgatagaagagcatggggtgctctggggaaatattggagggtcatccattccacattaaaagagcaagttgtctgc

SEQ ID NO: 165390 - DNA, 1690 bp, Homo sapiens
  Payload ID: 12558
  Gene Symbol: PDE4DIP
  Gene Name: phosphodiesterase 4D interacting protein
  Uniprot ID: Q5VU43
  ENST ID: ENST00000530472
  CDS Start-End: 325-1257
aaacttatctgaggttggaaataaagagaaggtgacattggagcggatagaaaggaagaaacggcgtgggatctgggaatgaggcagtgggtggagagagaatggggagacgacagaggatgaagggcagctgagtgtgtctgcgggagaaggaccaaagcaatctgggcggagcaggtggcagaggcagccgcggaggaggcccagggaactgacggggatgctcagccaggcccagaggatgcgccctggcagtcccggaaaacaccaggaaaacaagcaggaaccgtagctaggactggggtggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatagattcacttattcagcaaacatttactgggcatgccacatgccagataccgggctaagtatctggcatgtgttacagaaacaaaagacctaattcttgtcaccaagaaacatgttacatgattttaataagttccctgatagaagagcatggggtgctctggggaaatattggagggtcatccattccacattaaaagagcaagttgtc

SEQ ID NO: 165391 - DNA, 874 bp, Homo sapiens
  Payload ID: 12558
  Gene Symbol: PDE4DIP
  Gene Name: phosphodiesterase 4D interacting protein
  ENST ID: ENST00000616206
  CDS Start-End: 163-636
agggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagacatggagagtttgcatggtaatcaagaggcttttgaagactaaacctccgaacagctgtgtggtgctggtgggggaagcaaggatgctaacaccccaaccccctcctttttttgttttttttttttcaccttttggatctgctgtgatgcagaaagggcaagcagagctgcagagctcctcaaaactgtgtggggtgctctccaaaggccagccagcctgcatgttccttttcattgagagatgactggaaatatagaagtgaggggtgtcacctccattgaaagaatgggtggcagatataaggcccaaagtccttttcttttagagtttagatctaatatgacagattagtccttatttctcgatgctgggaaacactgacagaaaccaagctaagacgcagggaaaaggccaataagagatagtttaaatctctctctgctatgtgtcaaataaaaagtaaataaagaggctacaaccca

SEQ ID NO: 165392 - DNA, 819 bp, Homo sapiens
  Payload ID: 12558
  Gene Symbol: PDE4DIP
  Gene Name: phosphodiesterase 4D interacting protein
  ENST ID: ENST00000621371
  CDS Start-End: 1-199
gtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcgggagaattgaagaactgaatcagagcctggctgcccaggagaggcttgtagaacagctatctcgggagaaacaacaactgctacatctgttggaggagccaactagcatggaagtgcagttatagttccactgtattctactcaaaccttgtctgccatgccaactgtcaccacagaagaaagacccttacaatgtggaaggtaaaagttcaatttctaagctctgggcctgttcttcagaggctaaagaatctcctcatctccagtgaagccatccctggaatccctcactgattcagctggagtatggaggagcttaagttctaaagacctattcacttcctttaattccacctatacttcacaactgagaataccacaaacagttgggccctagaagaaagaagagctcacagatcttgcacttctaggtctgaattgtccaagtgaagaacgctaatttactccacatcccacagataactatctctcaagtgatcccagtatgaaagtctggagtatgagtataatatactcactgtaatatctgagtacaggaagttcacttcagagtcttcattctctcaaataagacagacacttttgataaagattattttatttaattga

SEQ ID NO: 165393 - DNA, 582 bp, Homo sapiens
  Payload ID: 12558
  Gene Symbol: PDE4DIP
  Gene Name: phosphodiesterase 4D interacting protein
  ENST ID: ENST00000617454
  CDS Start-End: 171-582
aaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaag

SEQ ID NO: 165394 - DNA, 2025 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000309641
  CDS Start-End: 1-648
atggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagggctctataatgggatcattgcatttctctgattactaatgagaaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagagg

SEQ ID NO: 165395 - DNA, 2599 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000317118
  CDS Start-End: 397-1953
agttccttatttggtagcttttgacaggactagcctttcttgcaactaagcatcttgacatacattattcattaagccctggagctcgggagagaaagatgcagacccttagatctttagatattcctttatcacgtggattttctttattcagaatagttgctgaattttgtgccattctggagtcttacaaatggcatgtattcgatgggaagacggctggatgggatttaatgcgaggctttcttatgtatacttaattaccaaaaatctttaaaaactcatactctgcgtggcttgtggaggttgttaaagtgtcgagattttgaagctaaatacattttagagcttactatatatatacatatatatatatatacatataatcaatcaaaaatgcctgaagcaaactatttactgtcagtgtcttggggctacataaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaa

SEQ ID NO: 165396 - DNA, 8232 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000340635
  CDS Start-End: 177-2606
gggccccctctcggtagccctgaggctctggcgccttcaagtgagaagctaagcaccagcctctgctgggctgcagaagcggcggcggcggcagcagcagcagcagcatcaggaaggcgctcgggccagcgcggtgaacccgggctgggcagcaggtcgcggagccgcgagccaggatggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaa

SEQ ID NO: 165397 - DNA, 2969 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000358923
  CDS Start-End: 554-2077
gtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcgggaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcatt

SEQ ID NO: 165398 - DNA, 3122 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000360047
  CDS Start-End: 125-2146
caatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatac

SEQ ID NO: 165399 - DNA, 2294 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000405755
  CDS Start-End: 130-2193
actgcacaaaggaaatgccctcactcagctacaagtgcctcctgctccgtgcggggcctcagggccccagagccccgcaccagctctgacttctcgtggttcctggggatcttggcatcgtccttaaaaatggcttttgtttgggatcctctgggagccacggtgccaggaccatctacaagagccaaatcaagattgcgtttctcaaagtcctacagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctg

SEQ ID NO: 165400 - DNA, 1430 bp, Homo sapiens
  Payload ID: 12559
  Gene Symbol: PDE4D
  Gene Name: phosphodiesterase 4D, cAMP-specific
  ENST ID: ENST00000505453
  CDS Start-End: 164-1430
gacagaagatctgcgaacatgatgcacgtgaataattttccctttagaaggcattcctggatatgaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagagg

SEQ ID NO: 165401 - DNA, 494 bp, Homo sapiens
  Payload ID: 12559
  Gene Symbol: PDE4D
  Gene Name: phosphodiesterase 4D, cAMP-specific
  ENST ID: ENST00000514552
  CDS Start-End: 271-494
ggtcacacagagagtacgtgtcaaaggaaactcaaaagaacacattttctcagtgattacaggttttagagaagaggaacaatgcttcctctgagcctgaagaaaagaatgaaataagggctgcaagggaacatgcaggtttcacactacaggagcttgtctgtcttggtgcaagtgggagcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccc

SEQ ID NO: 165402 - DNA, 2478 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000502484
  CDS Start-End: 225-2471
aagcacgagtcctatagttggcgtaccctgaggcctgccagttcctgccttaatgcatatgtagtcgtaattgagttctgacacggccttggatgtttctgtcctaaatagctgacattgcatcttcaagactgtcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtggttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgca

SEQ ID NO: 165403 - DNA, 2809 bp, Homo sapiens
  Payload ID: 12559
  Gene Symbol: PDE4D
  Gene Name: phosphodiesterase 4D, cAMP-specific
  ENST ID: ENST00000509368
  CDS Start-End: 252-305
aaagagaggctttctgtgtcctgggaatgttctgctaagaagacagtgatgataatagttaccactgaataagtactgacatgtgaggaactaccaggatccctgctttacaggaagaagccgaggctcagaagtacacttgtctaaggtcccagaacaagtcattccagttggcttttgagtggatacgtgcagtgagatcattgacactggaaacactagttcccattttaattacttaaaacaccacgatgaaaagaaatacctgtgatttgctttctcggagcaaaagtgacaaaaagtaagagatgtggagaggaagacaggaatactagggaaaagtttctctttctccaatcactcactctggaggcagctagctgtcaactcacaaagacactcaagcagcctatggaagaaggccacatggtaaaatatggaggcctccagccaacagtcagcaaggaactgagacaagtcaacaaccatgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtgggtgagtgccctcagatgtcatttccccattttatattttagatggtgattgttgtctgtggtcttttgagtttttgtggctcattgcttgatttgagtgggagaacaatggggtttctagagtcaaaaaaaaaaggatgaatttctcaggtgacatttctatatctgcaggagaagacattttagtgaaattgttttacatggaagagctgaaaatgtattggtgaatgctaataaacatttgccaaagggcagttgtacttggaaaattaatattggccatatgtgacttgatagaagacattttaacaaatgagaactaatggacaaattaccatgtagtgatacatgtctagaaacaataggaaatgttcactgatgcaaaatgaatttggaatcaagaataaattgtattgtaattagaatcaaaagaaatatgcaatggtattcatgagtctaaaaattttgcctttgacattttgaggtattgcttaccagaatactatttcagctcccagtataaggtgattttatttagcattagtacttatagaggagtcagccacagccacgtctccatcatgtaacatttttatttcctactttgcagggtataatttttgtttttattctttttcgtgttgtttaccaatggagttttacactttaaagcaatgtcaccagtttaaaaattgtgaaagaaagtaaggatattgggcacatcaattatttgttcttgtgaccagctgcatttttaagaagcctggatagaaaggaaagaggatgaagccagtgggccatacatagatagactcttgaacatttgctaaaactacaagaacaaaacaattactatgctacaaatgtgatggtcccacattctctgccaagttaaaggcatctctggggaaaatgtcttttggatcttgttaaagttaggaaggttgtgctcagaggaaatttggctagtaactcaactcaaagatactgaatttagctgttttacttgttattgaccagtctaagggacctgtgttagaaaaaggtatgaggaaaatactactagataaataataagaaaacaaatattcaccttgaagcaatgaaaagaggaaatatattttgtttctgttgttgtaattgaactatgtgtttaaagaagaatgcacacacattgatcagactcatactaaagcagatgggaattttatatgacagcttgacctgaacattttttgaaaaatgctgttcccctgaaactatttctcctttctttggaaataacattgctgccgttcattctgtgtagaagagattcacagatatcaggtgtatccagggatcccaagatcaccctcgggttcaatgatttgctagcagagctctcataattcagcaaatagtcatattcatggctctgatgtgttatagcaaaaggattcaatgcaaaataagcaaagggaaaggtagatggaacaaaatctggaggaaaccaaacataagcttccaagagtccccaagtgaagtaagacaagatacacttaattcctccagtaatgagttgagacaacacttgtgaaatgtgttcaccagggatgcctttaccagggaagcctattaaagactcagtacctagagtttttactggaggccagtcacttaggtaccctctgcctaggatatacaaacttccagatttccagaaggaaagtggatatgcagcataaaccacattatttgcacagacagtttaggcaaattgagccagtcttaccatttagagaatggtggatcactcctgaaagtcaggtctgctaaaggccaatgtttcaaacaggtcttcctatatttaattgacacagtcctgattaactgtttactacacaccaggttatcttagaatagttatcttactttcttcacacttgtggaagaagagattataattaaaattaaaatgcactaatttaaagccctgatatattcaattagctttggtatctcaaaaattttggttgctaaccatgatttctcattttgagttggtgttatatcatgtgcccttaaaataaaatgatgcaatatacctaa

SEQ ID NO: 165404 - DNA, 590 bp, Homo sapiens
  Payload ID: 12559
  Gene Symbol: PDE4D
  Gene Name: phosphodiesterase 4D, cAMP-specific
  ENST ID: ENST00000515835
  CDS Start-End: 335-424
atagttggcgtaccctgaggcctgccagttcctgccttaatgcatatgtagtcgtaattgagttctgacacggccttggatgtttctgtcctaaatagctgacattgcatcttcaagactgtggtctagctgtgtcccagagagcaacttcccttttcaaggcagcccactctgtgtgatgctttttcctaggtatgggcaacccatccctcctagggtgaaaacttcgctgttgctagttccagcattccagttggcttttgagtggatacgtgcagtgagatcattgacactggaaacactagttcccattttaattacttaaaacaccacgatgaaaagaaatacctgtgatttgctttctcggagcaaaagtcctgcttactgcgacctgatttttctcttgtggcccttaaaactatgaatatcaacagtcatccaattcttcaccttcatcttcctccctcagttgctgcctctgaggaaacactacattccagtaatgaagaggaagaccctttccgcggaatggaaccctatcttgtccggagactttcatgtcgcaatattcagcttccccctctcgcctt

SEQ ID NO: 165405 - DNA, 3350 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000507116
  CDS Start-End: 137-2374
agagagactgaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatac

SEQ ID NO: 165406 - DNA, 2860 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000503258
  CDS Start-End: 718-2757
ttctcactgccctgcggtgttttgaactgccttcttacagacgtcatacagcccttgaggaatagtttctgcctggtgagattgaatgatagttctcattcacaaaaccctggattctaagcagggacacacagaaattactttcgcaggtaaatcagcccacccagccaaagtgtggagagatttgttccttggctgacttctttgctccacggagaggagtgttttcctgtgcttgccctgaaatggaacttccttgacagctctcccgtgttacagtacctcccggtcattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgcc

SEQ ID NO: 165407 - DNA, 577 bp, Homo sapiens
  Payload ID: 12559
  Gene Symbol: PDE4D
  Gene Name: phosphodiesterase 4D, cAMP-specific
  ENST ID: ENST00000505507
  CDS Start-End: 335-577
atagttggcgtaccctgaggcctgccagttcctgccttaatgcatatgtagtcgtaattgagttctgacacggccttggatgtttctgtcctaaatagctgacattgcatcttcaagactgtggtctagctgtgtcccagagagcaacttcccttttcaaggcagcccactctgtgtgatgctttttcctaggtatgggcaacccatccctcctagggtgaaaacttcgctgttgctagttccagcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctg

SEQ ID NO: 165408 - DNA, 1040 bp, Homo sapiens
  Payload ID: 12559
  Gene Symbol: PDE4D
  Gene Name: phosphodiesterase 4D, cAMP-specific
  Uniprot ID: Q08499
  ENST ID: ENST00000502575
  CDS Start-End: 128-787
gaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaagtctttgcttgacct

SEQ ID NO: 165409 - DNA, 7690 bp, Homo sapiens
  Payload ID: 12559
  Gene Symbol: PDE4D
  Gene Name: phosphodiesterase 4D, cAMP-specific
  ENST ID: ENST00000546160
  CDS Start-End: 35-2071
ggaaaatattaatgacagcaaaacttgaattcacatgtttatttattctttcaacaagtttttctttaaaaccacacactgctgggctatcataagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgatacc

SEQ ID NO: 165410 - DNA, 3020 bp, Homo sapiens
  Payload ID: 12560
  Gene Symbol: PDE5A
  Gene Name: phosphodiesterase 5A, cGMP-specific
  Uniprot ID: O76074
  ENST ID: ENST00000264805
  CDS Start-End: 459-2960
gtggagcagagagtgcttggcgggcgggtgccccgaagcctgaggaattgatgcatagtcggggtgcgtggactccaggacgcgcccctttgcagaaagagtccgtgccccgctgccgcctgctctgggcagcggccgtcgggcagcgggtgctggccgtcttggccgggagggtgacacacgcccggcagtgatggtcgaggagcccgcccgggttcgacgcccgggtcccactcgccggcgcgcggccgcggctctgccggtcgctccccgccagggggcggcgcagcgcggggcgagcgggaggcgacgggcggcggcgcggaggccggggccgtgagggagctggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctag

SEQ ID NO: 165411 - DNA, 7154 bp, Homo sapiens
  Payload ID: 12560
  Gene Symbol: PDE5A
  Gene Name: phosphodiesterase 5A, cGMP-specific
  Uniprot ID: O76074
  ENST ID: ENST00000354960
  CDS Start-End: 321-2948
gctgccgccgccgccgccgcctcctgggaaccaggggactgaagagcctgcgagagcggaacactgccggaccccgggtggggggggcgcagcagctgcgcctggccccgcccaccacacctgggcgcccgtagaaccgcgcggggcggggcggggcaggaggctggcctggcgctccggccgctttgtcgaaagccggcccgactggagcaggacgaagggggagggtctcgaggccgagtcctgttcttctgagggacggaccccagctggggtggaaaagcagtaccagagagcctccgaggcgcgcggtgccaaccatggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaa

SEQ ID NO: 165412 - DNA, 6770 bp, Homo sapiens
  Payload ID: 12560
  Gene Symbol: PDE5A
  Gene Name: phosphodiesterase 5A, cGMP-specific
  ENST ID: ENST00000394439
  CDS Start-End: 95-2566
cctcgccctggccctggctgggcggggaagctggggtgagggacgagtccacgggacagcccaaaggcaacatgacggaaccttgccaaaagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatg

SEQ ID NO: 165413 - DNA, 747 bp, Homo sapiens
  Payload ID: 12560
  Gene Symbol: PDE5A
  Gene Name: phosphodiesterase 5A, cGMP-specific
  ENST ID: ENST00000420633
  CDS Start-End: 76-747
gggcggggaagctggggtgagggacgagtccacgggacagcccaaaggcaacatgacggaaccttgccaaaagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaa

SEQ ID NO: 165414 - DNA, 892 bp, Homo sapiens
  Payload ID: 12560
  Gene Symbol: PDE5A
  Gene Name: phosphodiesterase 5A, cGMP-specific
  ENST ID: ENST00000503412
  CDS Start-End: 1-557
ctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggtatttatatgaaaactactagacttgctaaacttggactgttgtgaattagaacctaaaattgaagagattaatattaggcgcctatattttgcttctaaatcaagaaataaaattattagcagtatggtttcttttactgatgaacatgtttgtattgaacaaggaacacatactaatatctattgagtgcctactatgtgctaatctccaacaaattgatttggggatgctaagaagaattatgtgccagtgttaccctcaaggagcaatactgtatatactatgcgttagcatattctttttttaagtctaaattttagcctaaataaagaaaagtaatccaa

SEQ ID NO: 165415 - DNA, 5642 bp, Homo sapiens
  Payload ID: 12561
  Gene Symbol: PDE6A
  Gene Name: phosphodiesterase 6A, cGMP-specific, rod, alpha
  Uniprot ID: P16499
  ENST ID: ENST00000255266
  CDS Start-End: 121-2703
agtatgttttgcagacaagacccagagaagtccagactggacttgttgcagactgcaaaactgccattggaaggcctccgtcccagtccttctacagagtagccagtgggattcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggatgagcatttctgtgactttgtggacatcctcacagagtacaagaccaagaacatcttggcttcccccataatgaatgggaaggatgtggtggccataatcatggctgtgaataaagtggatggatcccacttcaccaagagagatgaagagattcttctcaagtacctcaattttgcaaatctaatcatgaaggtgtaccacctgagttacctgcacaactgtgaaactcgacgtggccagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagaaattaacttttacaaggtcattgactacatcctgcatggcaaagaggacatcaaagtcatcccgaatccacctcctgaccattgggctttagtaagcggtctcccagcttatgttgcccagaatggcctgatttgcaacatcatgaatgcgcctgcggaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagattccaatatcaagattttgctacatgcatttcgtctgtcctttttacattttcttttcaattttttttcttacctgaagtgtttaaaggcaaatcctggccaggcgtggtggctcacacctgtaatcccagcacttcaggaggctgaggtgggcagactgcatgagcccaggagtctgagaccaacctgagcaaaatggcaaaaccctgtctctacaaaaaatacaaaaattagcactcacctgtagtctcagctacctgggaggcagaggtgagaggatctcttgaacccaggaggcggaagttgcagtgagctgagatcatgctactgcactccagcttgggcgaccgagcgagactctgactcaaacaaaagcaaaagaaaaggcaaatcccaaacatatcatttcacacctctactatctcatctttaaagaaataagtatgttttctaacataaccacatcactggcccatgcaaccaatgcctgcctaatacccagctgtgatctatgctttgatgggctgcacagaccccaagcttcagcaaaggacttgggaccccaccagctttgagtgctgttgacagacccttagtatcaaccccatcaggtgttactgcagccttccccagggtggcctacacccaatgactgatccatgccaggtggagaggcctggccatcttggctgagcatgggataactgtgcagggctgttccagctccacgactcctcgtggggtccactaaggctgtcgctgggctcacatcccaactcgacttctccctctgcccactcctatttccttcccttccccaagcatcggtccccagggcactgcttaataagcatcctgcagactaagtccattttagagtctgctttctgggacacccaacttgtgatgccagcccttaatcaaccttccttcattctcatgaacgttttcaatggttggcttgcctgaatctgatccaaacaaattcacatattgaatttagttgtttctttttgttggtttttagaaaaaagaagatgtactttttattcttggatttttcattgatttcacagagtataaattaagtcagattattctcaattccagaacttctgtttcttaaattagcaggcattctgttggtttaaaaagatagatgttggccgggcgcggtggctcacgcctgtaattccagcactttgggaggccaaggtgggtggatcacctgaggtcaggagttcaagaccagcctggccaacatggtgaaaccccatctctactaaaaatacaaaaattagctgggtgtggtggtgtgcacctgtaatcccagctactcaggaggctgaggcaggagaatcgcttgaacctgggaggcgaaggttgcagtgagctgagatcatgccactgcactccagcctgggcaacaagagcaagactccgtctcaaaaaaaaaaaaaagaaaaaaaaaagatgtggcagatagaatttctctctttctctatctttcatgacgaggtctcactctgtcgcccaggctggagtgcagtggtatgaccatagctcactggagccccagctgcccgggctcaagcaatcctccatctcagcttaccaagcagcggtgaccacaggcatgcaccaccatgcccagctaattttttaaaacctatctttgtagacatggggtctcattctgttgcccaggctggcctcaaactcctgacttcaagcaatcctcctgcctcagcctcccaaagtgttgggattacaggcgtgagccactgcacctggccaggacttatttcttttaaaccgaatctaagtatgttctggcaagtatgcaatacctagcggaatgcactggcctgatcagcattcataccatagtaactgatgttgaaaacagcacaaataaaccagaagttgaaaatggcaataacatgctaaaaatttgcaagtcaatttgttacacttgtccaaatcttgattttttttccttctctatcgttccccccccaccaccagctttatggaggtataattagcaaataaaaagtatacatatttaaggtatacactgtgatgttttgatatacattgtgaaatggttaccataattaagctaattaatatatccatcacctcacatagccatggttaagtttctgaagtctcttttaatctacaaagtactccttccttttttccattgtcatcaccttgcagaaacagagtcagttttcccacattctgtatttatctgtttgtttctttgtggccgcatgtaacacattcctctgtctcattctaataaatggacattagctcta

SEQ ID NO: 165416 - DNA, 5398 bp, Homo sapiens
  Payload ID: 12561
  Gene Symbol: PDE6A
  Gene Name: phosphodiesterase 6A, cGMP-specific, rod, alpha
  ENST ID: ENST00000613228
  CDS Start-End: 121-2460
agtatgttttgcagacaagacccagagaagtccagactggacttgttgcagactgcaaaactgccattggaaggcctccgtcccagtccttctacagagtagccagtgggattcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagaaattaacttttacaaggtcattgactacatcctgcatggcaaagaggacatcaaagtcatcccgaatccacctcctgaccattgggctttagtaagcggtctcccagcttatgttgcccagaatggcctgatttgcaacatcatgaatgcgcctgcggaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagattccaatatcaagattttgctacatgcatttcgtctgtcctttttacattttcttttcaattttttttcttacctgaagtgtttaaaggcaaatcctggccaggcgtggtggctcacacctgtaatcccagcacttcaggaggctgaggtgggcagactgcatgagcccaggagtctgagaccaacctgagcaaaatggcaaaaccctgtctctacaaaaaatacaaaaattagcactcacctgtagtctcagctacctgggaggcagaggtgagaggatctcttgaacccaggaggcggaagttgcagtgagctgagatcatgctactgcactccagcttgggcgaccgagcgagactctgactcaaacaaaagcaaaagaaaaggcaaatcccaaacatatcatttcacacctctactatctcatctttaaagaaataagtatgttttctaacataaccacatcactggcccatgcaaccaatgcctgcctaatacccagctgtgatctatgctttgatgggctgcacagaccccaagcttcagcaaaggacttgggaccccaccagctttgagtgctgttgacagacccttagtatcaaccccatcaggtgttactgcagccttccccagggtggcctacacccaatgactgatccatgccaggtggagaggcctggccatcttggctgagcatgggataactgtgcagggctgttccagctccacgactcctcgtggggtccactaaggctgtcgctgggctcacatcccaactcgacttctccctctgcccactcctatttccttcccttccccaagcatcggtccccagggcactgcttaataagcatcctgcagactaagtccattttagagtctgctttctgggacacccaacttgtgatgccagcccttaatcaaccttccttcattctcatgaacgttttcaatggttggcttgcctgaatctgatccaaacaaattcacatattgaatttagttgtttctttttgttggtttttagaaaaaagaagatgtactttttattcttggatttttcattgatttcacagagtataaattaagtcagattattctcaattccagaacttctgtttcttaaattagcaggcattctgttggtttaaaaagatagatgttggccgggcgcggtggctcacgcctgtaattccagcactttgggaggccaaggtgggtggatcacctgaggtcaggagttcaagaccagcctggccaacatggtgaaaccccatctctactaaaaatacaaaaattagctgggtgtggtggtgtgcacctgtaatcccagctactcaggaggctgaggcaggagaatcgcttgaacctgggaggcgaaggttgcagtgagctgagatcatgccactgcactccagcctgggcaacaagagcaagactccgtctcaaaaaaaaaaaaaagaaaaaaaaaagatgtggcagatagaatttctctctttctctatctttcatgacgaggtctcactctgtcgcccaggctggagtgcagtggtatgaccatagctcactggagccccagctgcccgggctcaagcaatcctccatctcagcttaccaagcagcggtgaccacaggcatgcaccaccatgcccagctaattttttaaaacctatctttgtagacatggggtctcattctgttgcccaggctggcctcaaactcctgacttcaagcaatcctcctgcctcagcctcccaaagtgttgggattacaggcgtgagccactgcacctggccaggacttatttcttttaaaccgaatctaagtatgttctggcaagtatgcaatacctagcggaatgcactggcctgatcagcattcataccatagtaactgatgttgaaaacagcacaaataaaccagaagttgaaaatggcaataacatgctaaaaatttgcaagtcaatttgttacacttgtccaaatcttgattttttttccttctctatcgttccccccccaccaccagctttatggaggtataattagcaaataaaaagtatacatatttaaggtatacactgtgatgttttgatatacattgtgaaatggttaccataattaagctaattaatatatccatcacctcacatagccatggttaagtttctgaagtctcttttaatctacaaagtactccttccttttttccattgtcatcaccttgcagaaacagagtcagttttcccacattctgtatttatctgtttgtttctttgtggccgcatgtaacacattcctctgtctcattctaataaatggacattagctct

SEQ ID NO: 165417 - DNA, 4039 bp, Homo sapiens
  Payload ID: 12561
  Gene Symbol: PDE6A
  Gene Name: phosphodiesterase 6A, cGMP-specific, rod, alpha
  ENST ID: ENST00000617647
  CDS Start-End: 121-2460
agtatgttttgcagacaagacccagagaagtccagactggacttgttgcagactgcaaaactgccattggaaggcctccgtcccagtccttctacagagtagccagtgggattcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagaaattaacttttacaaggtcattgactacatcctgcatggcaaagaggacatcaaagtcatcccgaatccacctcctgaccattgggctttagtaagcggtctcccagcttatgttgcccagaatggcctgatttgcaacatcatgaatgcgcctgcggaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagattccaatatcaagattttgctacatgcatttcgtctgtcctttttacattttcttttcaattttttttcttacctgaagtgtttaaaggcaaatcctggccaggcgtggtggctcacacctgtaatcccagcacttcaggaggctgaggtgggcagactgcatgagcccaggagtctgagaccaacctgagcaaaatggcaaaaccctgtctctacaaaaaatacaaaaattagcactcacctgtagtctcagctacctgggaggcagaggtgagaggatctcttgaacccaggaggcggaagttgcagtgagctgagatcatgctactgcactccagcttgggcgaccgagcgagactctgactcaaacaaaagcaaaagaaaaggcaaatcccaaagtgttgggattacaggcgtgagccactgcacctggccaggacttatttcttttaaaccgaatctaagtatgttctggcaagtatgcaatacctagcggaatgcactggcctgatcagcattcataccatagtaactgatgttgaaaacagcacaaataaaccagaagttgaaaatggcaataacatgctaaaaatttgcaagtcaatttgttacacttgtccaaatcttgattttttttccttctctatcgttccccccccaccaccagctttatggaggtataattagcaaataaaaagtatacatatttaaggtatacactgtgatgttttgatatacattgtgaaatggttaccataattaagctaattaatatatccatcacctcacatagccatggttaagtttctgaagtctcttttaatctacaaagtactccttccttttttccattgtcatcaccttgcagaaacagagtcagttttcccacattctgtatttatctgtttgtttctttgtggccgcatgtaacacattcctctgtctcattctaataaatggacattagctctag

SEQ ID NO: 165418 - DNA, 3280 bp, Homo sapiens
  Payload ID: 12562
  Gene Symbol: PDE6B
  Gene Name: phosphodiesterase 6B, cGMP-specific, rod, beta
  Uniprot ID: P35913
  ENST ID: ENST00000255622
  CDS Start-End: 44-2605
tgcgtgcctggagcagcagcgtctccagggacaggcagccaccatgagcctcagtgaggagcaggcccggagctttctggaccagaaccccgattttgcccgccagtactttgggaagaaactgagccctgagaatgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggatattttaatttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 165419 - DNA, 2120 bp, Homo sapiens
  Payload ID: 12562
  Gene Symbol: PDE6B
  Gene Name: phosphodiesterase 6B, cGMP-specific, rod, beta
  Uniprot ID: P35913
  ENST ID: ENST00000429163
  CDS Start-End: 267-1994
gcagcggaggagagggagctggcaccatgcggtagaagacccagcggccgccgcgagtgtgaggaggcagggcctggtggggcctgggtctgggccttgaccaaggaggcagagaaaggtggcccaaggagggccctggggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggata

SEQ ID NO: 165420 - DNA, 549 bp, Homo sapiens
  Payload ID: 12562
  Gene Symbol: PDE6B
  Gene Name: phosphodiesterase 6B, cGMP-specific, rod, beta
  ENST ID: ENST00000461490
  CDS Start-End: 1-449
ctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgataggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggatattttaatttttttttttttttttttttgagatggagtcttgctctgtcacccaggctggagtgccgtggcacgatctcagc

SEQ ID NO: 165421 - DNA, 580 bp, Homo sapiens
  Payload ID: 12562
  Gene Symbol: PDE6B
  Gene Name: phosphodiesterase 6B, cGMP-specific, rod, beta
  ENST ID: ENST00000471824
  CDS Start-End: 1-435
accctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaagtaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagagg

SEQ ID NO: 165422 - DNA, 522 bp, Homo sapiens
  Payload ID: 12562
  Gene Symbol: PDE6B
  Gene Name: phosphodiesterase 6B, cGMP-specific, rod, beta
  ENST ID: ENST00000487902
  CDS Start-End: 231-522
gtgactgcggccagggcggctccacgacggtgactggggtcagggcaggagagtgtggaggccagtgaggagggtccacacccatcggtgaggcaggagtcagggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcctccacggcaaggaggagatcaaggtcattcccacaccctcagccgatcactgggccctggccagcggccttccaagctacgtggcagaaagcggctttgaaggggccctggacgactccgggtggctcatcaagaatgtgctgtccatgcccatcgtcaacaagaagg

SEQ ID NO: 165423 - DNA, 450 bp, Homo sapiens
  Payload ID: 12562
  Gene Symbol: PDE6B
  Gene Name: phosphodiesterase 6B, cGMP-specific, rod, beta
  ENST ID: ENST00000465426
  CDS Start-End: 326-450
gaggagaatgcacctggcgattccacacatctacagcgagtctcctgagccgcaggcgccggggctgtggagagccgtctccattcagcaggcgccagggctatggggagccgtctccattcagcaggctctggagctatgaagagccgtctccattcagcaggcgccggggctatggggagccgtctccattcagcaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcct

SEQ ID NO: 165424 - DNA, 560 bp, Homo sapiens
  Payload ID: 12562
  Gene Symbol: PDE6B
  Gene Name: phosphodiesterase 6B, cGMP-specific, rod, beta
  ENST ID: ENST00000488061
  CDS Start-End: 541-560
accgcagcggaggagagggagctggcaccatgcggtagaagacccagcggccgccgcgagtgtgaggaggcagggcctggtggggcctgggtctgggccttgaccaaggaggcagagaaaggtggcccaaggagggccctgggacgcttggcggaggccacaggcggcctgacgtgcggaaaccacggcccgatgttctcaaagccctgctcgccgcaggtggttctggagcagccgggcggaggaagggctggtcggatgtttgcctgtcaagctcaaagcgacagattccactttccactcgtccactcctgagtgatcagggacacgaccgcagcctcgaggcctcaccgccagccagctcccgggccccacaagctcagatgaaacctggccacggagccaccaatcagggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaatt

SEQ ID NO: 165425 - DNA, 3232 bp, Homo sapiens
  Payload ID: 12562
  Gene Symbol: PDE6B
  Gene Name: phosphodiesterase 6B, cGMP-specific, rod, beta
  Uniprot ID: P35913
  ENST ID: ENST00000496514
  CDS Start-End: 22-2586
ctccagggacaggcagccaccatgagcctcagtgaggagcaggcccggagctttctggaccagaaccccgattttgcccgccagtactttgggaagaaactgagccctgagaatgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggatattttaatttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcag

SEQ ID NO: 165426 - DNA, 3307 bp, Homo sapiens
  Payload ID: 12563
  Gene Symbol: PDE6C
  Gene Name: phosphodiesterase 6C, cGMP-specific, cone, alpha prime
  Uniprot ID: P51160
  ENST ID: ENST00000371447
  CDS Start-End: 139-2715
ctttggaagtcctatgagggaccatttacggtttcctcagtaatttccaccaggatgaatttccttctcatcactctgcctcaggtagtgctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaagaacagccatttttctgacttcatggacaagcaaactgggtatgtcactaagaacctgctggcaaccccgatcgtggtgggcaaggaggttcttgctgtgatcatggcagttaacaaagtaaatgcatctgaattttccaaacaggatgaagaggtcttttccaaatacctcaactttgtgtctatcatcctaaggcttcatcacaccagctacatgtacaatattgaatcccgaagaagccagatccttatgtggtcagccaataaagtatttgaagaactcacagatgttgagcgacagtttcacaaagcgctctacacggttagatcatatctgaactgtgaacgatactccattggactgctggacatgaccaaggagaaggaattctacgatgaatggccaatcaagcttggagaagtagagccttataaaggtccaaagacacctgatggcagggaagtcaacttttataaaatcattgattacattttacatggaaaagaagagatcaaagtgattccgacgcctcctgcagaccactggacactcattagtgggttgccaacatatgttgctgaaaatggatttatctgtaacatgatgaatgcccctgcggatgaatacttcacatttcagaaaggacctgtagacgaaactggttgggtcattaagaatgttttgtccctgcctattgtcaacaagaaagaagatattgtgggagtggctacattttacaacaggaaggatggaaaacctttcgatgagcatgatgaatacattaccgagactctcacacaatttcttggatggtctcttttaaatactgacacctacgataagatgaataagctagaaaacagaaaggacattgctcaggaaatgctcatgaaccaaaccaaagccactcctgaagaaattaagtccattttgaaatttcaagagaagttaaatgttgatgtaattgacgactgtgaagaaaaacaacttgttgcaattttgaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggttcttaccagatggatgtacactgtgaggaaagggtaccgagctgtcacttaccacaattggcggcatgggttcaacgtggggcagaccatgtttactttgctgatgacaggaagattaaagaagtactacacagatctcgaagcctttgccatgcttgctgctgctttctgccatgatattgaccacagaggcaccaataatttgtaccagatgaaatccacgtctccattagcaagacttcatggttcttctattttggagaggcaccacctggagtacagtaagactctgttgcaggatgagagtttaaacatcttccagaacctaaataagcggcagtttgaaacagttattcatttgttcgaggtcgcaataatagcaactgacctggctttatatttcaagaagaggaccatgtttcaaaaaattgttgatgcctgtgaacaaatgcaaacggaagaagaagccatcaaatatgtaactgttgatccaaccaagaaagagattatcatggcaatgatgatgacggcatgtgacttgtctgctattaccaagccctgggaggtgcaaagtcaggtagcacttatggttgcaaatgaattttgggaacaaggagatctggagagaacagtgttgcagcaacaacccattcctatgatggacagaaacaaaagagatgaattacctaaacttcaagttggatttattgattttgtttgtacttttgtatataaggagttctcacggtttcacaaagaaatcacacctatgctgagtggtcttcagaataacagagtagaatggaaatcactagctgatgagtatgatgcaaagatgaaggtcattgaagaggaggcaaaaaagcaagaaggaggagccgaaaaagctgctgaagattcaggaggtggtgatgacaaaaagtccaaaacatgtttaatgttgtaatattatctaactggtctaaacttcaaatatcattttacctttgaagaaaaccagaaaacattcaaaagaacttcaacaaatcatcacgtaacaggatcttcagaaaaactaccctgtgactatgaagaaaatatatattgctagcccaaaaatcccaggggcaaaataaagttcaacaaaagtgcaaaatatgacaaaaataggtacatttttggtgccaatttattttaaattaaaaaatatgcaatcctgaaactagtcacaaattcttttttaaaacattaattgtatttatttgctaaggctgctataacaaagtaccacagactgggtgcttaaccaatagaaatgtattttctcaaagtcctgggggctggaagttcaagatcaaggagttggcagggttggtttcttgggaggcctctcaacttggtttgcagatggccatcttctccctgtgtcttcacatggtcttccctctgtgtgtctgtgtcctaatctccttttcttataaggactccagtaggactggattagggcctacccatgtgacctcattttagtcttaattacctcgttaatggccttatct

SEQ ID NO: 165427 - DNA, 1175 bp, Homo sapiens
  Payload ID: 12564
  Gene Symbol: PDE6D
  Gene Name: phosphodiesterase 6D, cGMP-specific, rod, delta
  Uniprot ID: O43924
  ENST ID: ENST00000287600
  CDS Start-End: 196-648
ctgcgaggctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatggca

SEQ ID NO: 165428 - DNA, 672 bp, Homo sapiens
  Payload ID: 12564
  Gene Symbol: PDE6D
  Gene Name: phosphodiesterase 6D, cGMP-specific, rod, delta
  ENST ID: ENST00000409772
  CDS Start-End: 178-459
ggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagtgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccag

SEQ ID NO: 165429 - DNA, 627 bp, Homo sapiens
  Payload ID: 12564
  Gene Symbol: PDE6D
  Gene Name: phosphodiesterase 6D, cGMP-specific, rod, delta
  ENST ID: ENST00000428104
  CDS Start-End: 314-627
ggcggggagggggtggctaggggcccaaggagaggaatgcggcctagacggtactgcagcccaaccgtcgccatcgccatcccgggccccaaatcctccccttaggctgtgctttctctctcaggagctccccatggctactgcgctacccctgggcaccgagatacattaagcctactaactaccacttattgagcgttttaccatgtgccagccttaccatgatttgcagatgtctgagttccatgtaaacagaagttaactctctgcgggctgtcatcttcttttgaggtcatatttgatcagaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaac

SEQ ID NO: 165430 - DNA, 1029 bp, Homo sapiens
  Payload ID: 12565
  Gene Symbol: PDE6G
  Gene Name: phosphodiesterase 6G, cGMP-specific, rod, gamma
  Uniprot ID: P18545
  ENST ID: ENST00000331056
  CDS Start-End: 151-414
atgaagcagcgagataaaggccggggctggcaccctgcggagggaggcccagcactcacagcacagccccctgagacccgccctgcacttgaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcc

SEQ ID NO: 165431 - DNA, 526 bp, Homo sapiens
  Payload ID: 12565
  Gene Symbol: PDE6G
  Gene Name: phosphodiesterase 6G, cGMP-specific, rod, gamma
  Uniprot ID: P18545
  ENST ID: ENST00000571224
  CDS Start-End: 114-377
tcctctctgctgggcggccttgccgacgcacttttctcagcaagaattcccgaaaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacata

SEQ ID NO: 165432 - DNA, 1505 bp, Homo sapiens
  Payload ID: 12565
  Gene Symbol: PDE6G
  Gene Name: phosphodiesterase 6G, cGMP-specific, rod, gamma
  ENST ID: ENST00000573076
  CDS Start-End: 477-890
ggcttgcccttgaaggaactcaacattgtccttgcttctgtgcttgggaagacccacaggcccctaagggcgggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgagcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttgaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcc

SEQ ID NO: 165433 - DNA, 812 bp, Homo sapiens
  Payload ID: 12565
  Gene Symbol: PDE6G
  Gene Name: phosphodiesterase 6G, cGMP-specific, rod, gamma
  ENST ID: ENST00000574024
  CDS Start-End: 1-213
gataaaggccggggctggcaccctgcggagggaggcccagcactcacagcacagccccctgagacccgccctgcacttggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcc

SEQ ID NO: 165434 - DNA, 458 bp, Homo sapiens
  Payload ID: 12565
  Gene Symbol: PDE6G
  Gene Name: phosphodiesterase 6G, cGMP-specific, rod, gamma
  Uniprot ID: P18545
  ENST ID: ENST00000571004
  CDS Start-End: 84-347
ctccaggctcaggacctgccacagaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggaca

SEQ ID NO: 165435 - DNA, 747 bp, Homo sapiens
  Payload ID: 12566
  Gene Symbol: PDE6H
  Gene Name: phosphodiesterase 6H, cGMP-specific, cone, gamma
  Uniprot ID: Q13956
  ENST ID: ENST00000266395
  CDS Start-End: 107-358
caaagatccttttgtcttttgcaaagaaggcagctgggcagctgataggaacaacattcagctccgaggctgaaagggaaacatcagccgcccggggggagttaaaatgagtgacaacactactctgcctgctccagcttcaaaccagggtcctaccaccccacgcaaaggccctcccaagttcaagcagaggcagactcgccaattcaagagtaaacctccaaagaaaggtgtgaaaggatttggagatgacattccaggaatggaggggctaggaacagatatcacagtgatttgtccatgggaggcattcagccacctggaattgcatgagctcgctcagtttgggattatctgaagtgccagaggttctgccactctcaatgacatctgctgtaattttggttgcttttgccctgttgatctgccggagtcttgaaattcagctgattggaagtggtttctttgactttcaaggtcattccctatcagttactactaagagttctcttactgtcagaatctctcttgcagtacagctcaaaatagtggatgcatttcaaacttgaccaccttttcctaccagctagttagaagtcatcaatatttctctacattttgtttatctgtaagtcctttaaatctatttttgctaggcattcattatgattaatagtagacttttaagacaacatttatgtcactccccacctcctcatatttaataaaggagatatttaccttgaa

SEQ ID NO: 165436 - DNA, 2425 bp, Homo sapiens
  Payload ID: 12567
  Gene Symbol: PDE7A
  Gene Name: phosphodiesterase 7A
  Uniprot ID: Q13946
  ENST ID: ENST00000379419
  CDS Start-End: 144-1514
ggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatggg

SEQ ID NO: 165437 - DNA, 2986 bp, Homo sapiens
  Payload ID: 12567
  Gene Symbol: PDE7A
  Gene Name: phosphodiesterase 7A
  Uniprot ID: Q13946
  ENST ID: ENST00000396642
  CDS Start-End: 1-1275
atggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggtaactatacatatttagatatagctggttagaaaaatgccactgtttttatcaagaagggaaatatatttgaaatataaaatattaaaattatgctcatttctatttttaaaaataatttaagaaattttacccttgttttcccttgttatggctcttctaattctcatttaattttaggatgtaaaaagtatatttttgcagaacaggcagcagcaataacttgtttctgttcttatgtaaataagaatccattattcgctcatgtggaagcttcttttgcatcatttgggactgccatttaaaaaaggataggtaaacaaagaaatgacaaaaataaaataaataaaataaaaatggataggtggtgacccactgagcctgatcataatacgaagaccagcttctgccactgcctttccagactcttaccactgcctgttgattaaatctaactcttcaacatcctagacaggcccttataatcttgcttcaaatgctgtgcagccatcttgcctcaacttccctctcatttgcctacagcatctcgggacgcttctgtgtttcccaagtatacgctgttctttcgctctttgtgcctcgccagtgctttccatgtgcctcgtagagttatttttcttgaagaggcagctcaaatgtcaccttctccagaagctgctctccacttgctttaggcagagtcagtcacttttcttctagattccaaagtgcctgatccacttggttgtggattcctggagcctagcaccacaccagaagcacgaggcccttgagaactgtgtgttgagtgaactaataactgtattatagaaagcataatgaaaatgtcctgtgactgaagtatgtgtagcttgttgcaggagttcacaggaaagttgactaggattgagtgtgttgggctttgggtataaaggagggggattctacgggggcagtagctcaacaaggaatagagggaggagtgtaattttggtagctggtgttgaatagggcctttgagaatcagactgaacacagtgaaatatgtgcccaaagttcagaaagatgaagtttccagaaactaagaaggtagcacaatatgtggcatcatactcagaaaggaagaccatgccatggggccagaaattcagaaacgtaattcttacattgtgattgcaatggatactcatggaagaaagtgggtagtggccgatttgacttcagagtgacaggtagagaagggaagagcgtgtagaactgtggccagactttaggagtgtgagggatgctgaatctcccagagagctcacactggccaggaatgctgagagtagcagatgcttttcttttgggaggatagtaaaacaatttagaaccagatatgctttgtcttgattctcaagtagaataatcttcaaatgcaaaagaatacattagaaatggacaaaagtggccaggagcggtagctcatacttgtaacccagcactttgggaagccgaggcgggctgatcgcttgaggtcaggagttcgagaccagcctggccaaaatagtgaaactcacgtttctactaaaaatacaaaaattagctgggtgtgatggccacttgggaggctgagataggagaatcgcttgaacctgggaggcagaggttgcagtgagccaatatcgtgccactgcattccagcctgggtgacagaatgaaactccatcactccatctcaaaaaaaaaaaaaaaaaaaaa

SEQ ID NO: 165438 - DNA, 3673 bp, Homo sapiens
  Payload ID: 12567
  Gene Symbol: PDE7A
  Gene Name: phosphodiesterase 7A
  Uniprot ID: Q13946
  ENST ID: ENST00000401827
  CDS Start-End: 445-1893
gctgctcctgagtcccgcgcgccctgggtctggccgctggctccagctgtcttttcttgcactgctttgctccgttcgtgctgcgctcgaactctgcagtccgggtacctgctcctctcggccgaggagccccagggcggcggggttccctttccgactttgcctgtgctggccccgcttgcaccccgtcccccctcgcctggagcgaggcgcgcgccggtcctggtaattggcgccgcggccgccgcggagccttcccgccggcggcccgagcggagggctggggttggggaggcgtgagcgcggcttcccagcccggggtcggtccccgcccgccctgcccccgtctcggcccggagcccccgagccgcggccccctcccactgcaggggccggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcatatttttatctttgacatttaccttataactcaatcttttggaaaacacaatgctaaattacaaggaaatcaaagttagcttcttggctcttgtaattcatccctcagatgtttactcagtccgagcttatctactaatgactcaccttgcaagtgagtaagcagaagcccagtt

SEQ ID NO: 165439 - DNA, 572 bp, Homo sapiens
  Payload ID: 12567
  Gene Symbol: PDE7A
  Gene Name: phosphodiesterase 7A
  ENST ID: ENST00000523253
  CDS Start-End: 316-572
agaagaaaaactcttagaagccagcaacttttacaagcaccctgggacatttagttgaggggcttgagtgttgtataacacaataatttttagtcagaataatgttaatagagcctgtttttaaaagttgaaagattcgtactgtttttttgtttttaaaaagatttccatgccaaagagttttaagtattgatgctgaactgaaatggacaagcttgagttacctggaaaattcatttatgtggatggaacaccagctcttccaaggatgccaatagaagagagagattatgcagcgggcttttgattgatccaatgggaattacattgatctggtgtctggccttggttcttatcaagtggatcacctctaagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctact

SEQ ID NO: 165440 - DNA, 5390 bp, Homo sapiens
  Payload ID: 12568
  Gene Symbol: PDE7B
  Gene Name: phosphodiesterase 7B
  Uniprot ID: Q9NP56
  ENST ID: ENST00000308191
  CDS Start-End: 304-1656
cagtcagttggtctgggcactgcagcaggctcggctctgtcccagcacttgtctgggagaaaagtggtgttactcacccagggagagtctctctttctaccttccttctttctcgatctccttgtgtgcttttgtgtttctttatttcttttccttttttttctttttttttttttgttacttaattatattcctaatcctggatgaagttgctggattctgcagcacaagtcttcatgaacaagcagcaccgctcagagatttcacggcattcaaaggtcacagaactgccactatggttaaatgtcttgtttaatggttgagaggtgtggcgaaatcttgtttgagaaccccgatcagaatgccaaatgtgtttgcatgctgggagatatacgactaaggggtcagacgggggttcgtgctgaacgccgtggctcctacccattcattgacttccgcctacttaacagtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcagaatatgtctgtgctggagaatcatcactggcgatctacaattggcatgcttcgagaatcaaggcttcttgctcatttgccaaaggaaatgacacaggatattgaacagcagctgggctccttgatcttggcaacagacatcaacaggcagaatgaatttttgaccagattgaaagctcacctccacaataaagacttaagactggaggatgcacaggacaggcactttatgcttcagatcgccttgaagtgtgctgacatttgcaatccttgtagaatctgggagatgagcaagcagtggagtgaaagggtctgtgaagaattctacaggcaaggtgaacttgaacagaaatttgaactggaaatcagtcctctttgtaatcaacagaaagattccatccctagtatacaaattggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaactttaaacatctttcatcttctgaaagctgcccaacttaaatcctcatagatgtctttctcaactgccttcccatgttcatctgtatgttttccagctaaggtcacaaaccaaaactgaataaagtctttgaggaaacattttggaaacttcacatgcattccgcttgagaccatagtgtttaatctatggcaccaagcatcgtttcctcagattaatgagacccttcaacaagcctgaatcagtcacttttcaacacagcgatgttttaacaagccagctgctaagcttgtgtttatgtgactcttgttacagatcatggcggtgcgtcagcctcacaggagacatagcaggtctcagaaaccttctatgaccctgtcatctaaccatcagggaattccctgctcccatgccacacatttgtctattatggctatagtaccaaagtacttttggtgtttggttggtgtgcatttctttagtgtcgatagtaactggatttttctttttccttaatctcatgtgaacaactacccaactgtttagctgaagttcatattatttaagtaaagaaaatatttcagttttataacagactttaccttcctggcaggtcattgtagttaattatgtctctagcttggagtgtcaccttggaatttcgttgccattttttctcagacacctggccgtaaaatcagtttgttacagcattcttctctaggctgctaaacgctgtgcattgaaccttttctttagaagtttcagcgtaactaatgttagatgaaaattgttgatgcccctttctttttactttaaacaatgtggtagtgggagaatgactgtttctgccactatcaacctgatcctcatgctgatagaatgacagctagcacttatttcctaagtgcaactgttttagagatttttctcctaacatgcaaaggaaatactgattggcctataataagttcctatagggagactgaggcttgcagaattaaggttcaggggaaattttggaaagttggttgtattttcattgaagtaggagagattatcagatggtgctaaagaaagtgtgaagatcttatgaaataggtggatggtaagttgaaattattgatgtgggtaagaagggaggttgtggaaagttaacactagctttgtatttttttttctgtaaaactgtgaactgatatattttcctttatcactttagtattctgcagttctcagcttggtgaggctccaaaagagaatatgtcagatgtattcctacttccaaacctgtcttactttggtttgatggtacacatagggcttttgaacagtctatttttaatgtatatgaggtcaaatcaaggaaggcaattgctggggacaagaaaagtagaggtaggaaagaagacactattttagctaatggggtttcttgggactaaaaaatggctttgtttaaattataattatataataatttaaataaatgagattggaggtattcttagtagttctgagttgatagtttacattacaattaggtcttgaagaagagctcacagagaaaaaactaccaaatatccaatgggtaagcccatgatgtagccactagtacaataaaaatctgaagtaaaatgaggcataaacttgatgcagctgcctccctcattcaactggggagttcttgagttcctcatttgttggtaaaaagaaaaagaatgtgaaaatgtctctttttttcttggctattagtggctgtcttgcaatatttcaataggagtccaattactagttaaaacactggcggggtgcggtggctcacgcctgtaatcctagcactttgggaggccaagttgggcagatcacaagttcaagagatcgagaccattctggccaacatggtgaaaccccgtctctactaaaaatacaaaaattagctgggcatggcagtgcgtgcctgcaatcccagctactcaggaagctgaggcaggagaatcgcttgaacctgggaggtggaagttgtagtgaactgagatcgcaccactgcactccagcctggcaacagagctagaatccgtctcaaacaaacaaacaaaaaatcccacagctattggatcatccacagattttttctttacaatcttgttctccttgtccatggaccatcaatagttgacttgccaggtttaattctttcattgcttgagaagaaaggaatcaaaggactgtgtgtagtaagctgacggtaaagttaagattaaattaagacagagagagaatacatatcactgccaggcctgataggaaaaatctgctcttccttttaataacagtgatgaattgtcaggaccttatttaggaaaccctgacctacccataactccctgctaggctaagtagaaaccaggttatttctccctgcttatggctccccgcaaagggacttgcagcgtgtcctgcaactttgtcttcagatagtgcttcctacaaaactaggtcttgttttgtaatcttttctcgtgttgaatcagatctgcttacttatttaggtttggttatgagcttgtatctcactgtatttctcatgctttgttcttttaaacaaatcctttaaactgtgtcattttgtatacacatgtgaggtttgaaaaaaaaaaaaaaaaaaaaaagaactaccttgtgagttttgctcaaaatgtggcctaagtagccattggcatgtctagatgaacaaataaaaataaagataatttctttaaaatatca

SEQ ID NO: 165441 - DNA, 711 bp, Homo sapiens
  Payload ID: 12568
  Gene Symbol: PDE7B
  Gene Name: phosphodiesterase 7B
  ENST ID: ENST00000446774
  CDS Start-End: 1-601
gcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcaggtaagggagcccaacctggagccagccacagtatggtcaatcgccttaggcccggtgctcaagcctgaatcttgcccatggagaaagccttgttttagggtcctagaagttcaaagacgaatgaaacacaatctctgccctcaaaaatttgttcaaactcagatgctcaaaatgagcaaaatccaagcaaacttaatcccagtttgaaagaggtttgaggaattagctcatgtcgatacaattgttttttaaaatctctaaagagtaaatacttgtgctgttctttgtatccaaagaccttactagaataaagtgag

SEQ ID NO: 165442 - DNA, 5234 bp, Homo sapiens
  Payload ID: 12568
  Gene Symbol: PDE7B
  Gene Name: phosphodiesterase 7B
  ENST ID: ENST00000615259
  CDS Start-End: 1-1509
atgcctgtgctagagcgatatttccacccagcagagctaggcaggaggtggacaggcccagaaggtgtgctgccctcctccccgggaagccggccggggtgccagcaggggccgctgccctgggacttgccagagatgatcaggatggtaaagctggtttggaaatccaaaagtgagctgcaggcgaccaaacagagaggcattctggacaatgaagatgctctccgcagctttccaggagatatacgactaaggggtcagacgggggttcgtgctgaacgccgtggctcctacccattcattgacttccgcctacttaacagtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcagaatatgtctgtgctggagaatcatcactggcgatctacaattggcatgcttcgagaatcaaggcttcttgctcatttgccaaaggaaatgacacaggatattgaacagcagctgggctccttgatcttggcaacagacatcaacaggcagaatgaatttttgaccagattgaaagctcacctccacaataaagacttaagactggaggatgcacaggacaggcactttatgcttcagatcgccttgaagtgtgctgacatttgcaatccttgtagaatctgggagatgagcaagcagtggagtgaaagggtctgtgaagaattctacaggcaaggtgaacttgaacagaaatttgaactggaaatcagtcctctttgtaatcaacagaaagattccatccctagtatacaaattggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaactttaaacatctttcatcttctgaaagctgcccaacttaaatcctcatagatgtctttctcaactgccttcccatgttcatctgtatgttttccagctaaggtcacaaaccaaaactgaataaagtctttgaggaaacattttggaaacttcacatgcattccgcttgagaccatagtgtttaatctatggcaccaagcatcgtttcctcagattaatgagacccttcaacaagcctgaatcagtcacttttcaacacagcgatgttttaacaagccagctgctaagcttgtgtttatgtgactcttgttacagatcatggcggtgcgtcagcctcacaggagacatagcaggtctcagaaaccttctatgaccctgtcatctaaccatcagggaattccctgctcccatgccacacatttgtctattatggctatagtaccaaagtacttttggtgtttggttggtgtgcatttctttagtgtcgatagtaactggatttttctttttccttaatctcatgtgaacaactacccaactgtttagctgaagttcatattatttaagtaaagaaaatatttcagttttataacagactttaccttcctggcaggtcattgtagttaattatgtctctagcttggagtgtcaccttggaatttcgttgccattttttctcagacacctggccgtaaaatcagtttgttacagcattcttctctaggctgctaaacgctgtgcattgaaccttttctttagaagtttcagcgtaactaatgttagatgaaaattgttgatgcccctttctttttactttaaacaatgtggtagtgggagaatgactgtttctgccactatcaacctgatcctcatgctgatagaatgacagctagcacttatttcctaagtgcaactgttttagagatttttctcctaacatgcaaaggaaatactgattggcctataataagttcctatagggagactgaggcttgcagaattaaggttcaggggaaattttggaaagttggttgtattttcattgaagtaggagagattatcagatggtgctaaagaaagtgtgaagatcttatgaaataggtggatggtaagttgaaattattgatgtgggtaagaagggaggttgtggaaagttaacactagctttgtatttttttttctgtaaaactgtgaactgatatattttcctttatcactttagtattctgcagttctcagcttggtgaggctccaaaagagaatatgtcagatgtattcctacttccaaacctgtcttactttggtttgatggtacacatagggcttttgaacagtctatttttaatgtatatgaggtcaaatcaaggaaggcaattgctggggacaagaaaagtagaggtaggaaagaagacactattttagctaatggggtttcttgggactaaaaaatggctttgtttaaattataattatataataatttaaataaatgagattggaggtattcttagtagttctgagttgatagtttacattacaattaggtcttgaagaagagctcacagagaaaaaactaccaaatatccaatgggtaagcccatgatgtagccactagtacaataaaaatctgaagtaaaatgaggcataaacttgatgcagctgcctccctcattcaactggggagttcttgagttcctcatttgttggtaaaaagaaaaagaatgtgaaaatgtctctttttttcttggctattagtggctgtcttgcaatatttcaataggagtccaattactagttaaaacactggcggggtgcggtggctcacgcctgtaatcctagcactttgggaggccaagttgggcagatcacaagttcaagagatcgagaccattctggccaacatggtgaaaccccgtctctactaaaaatacaaaaattagctgggcatggcagtgcgtgcctgcaatcccagctactcaggaagctgaggcaggagaatcgcttgaacctgggaggtggaagttgtagtgaactgagatcgcaccactgcactccagcctggcaacagagctagaatccgtctcaaacaaacaaacaaaaaatcccacagctattggatcatccacagattttttctttacaatcttgttctccttgtccatggaccatcaatagttgacttgccaggtttaattctttcattgcttgagaagaaaggaatcaaaggactgtgtgtagtaagctgacggtaaagttaagattaaattaagacagagagagaatacatatcactgccaggcctgataggaaaaatctgctcttccttttaataacagtgatgaattgtcaggaccttatttaggaaaccctgacctacccataactccctgctaggctaagtagaaaccaggttatttctccctgcttatggctccccgcaaagggacttgcagcgtgtcctgcaactttgtcttcagatagtgcttcctacaaaactaggtcttgttttgtaatcttttctcgtgttgaatcagatctgcttacttatttaggtttggttatgagcttgtatctcactgtatttctcatgctttgttcttttaaacaaatcctttaaactgtgtcattttgtatacacatgtgaggtttgaaaaaaaaaaaaaaaaaaaaaagaactaccttgtgagttttgctcaaaatgtggcctaagtagccattggcatgtctagatgaacaaataaaaataaagataatttcttt

SEQ ID NO: 165443 - DNA, 3984 bp, Homo sapiens
  Payload ID: 12569
  Gene Symbol: PDE8A
  Gene Name: phosphodiesterase 8A
  Uniprot ID: O60658
  ENST ID: ENST00000310298
  CDS Start-End: 253-2742
agtagccgggccaaggcgggagcggctgcctctcagggtcgctccagggccgcgctaggaaagccgccgccgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaatca

SEQ ID NO: 165444 - DNA, 2663 bp, Homo sapiens
  Payload ID: 12569
  Gene Symbol: PDE8A
  Gene Name: phosphodiesterase 8A
  Uniprot ID: O60658
  ENST ID: ENST00000339708
  CDS Start-End: 183-2534
cgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagc

SEQ ID NO: 165445 - DNA, 3912 bp, Homo sapiens
  Payload ID: 12569
  Gene Symbol: PDE8A
  Gene Name: phosphodiesterase 8A
  Uniprot ID: O60658
  ENST ID: ENST00000394553
  CDS Start-End: 190-2679
ccgccgccgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttcttttt

SEQ ID NO: 165446 - DNA, 2999 bp, Homo sapiens
  Payload ID: 12569
  Gene Symbol: PDE8A
  Gene Name: phosphodiesterase 8A
  ENST ID: ENST00000485596
  CDS Start-End: 183-1001
cgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagccctgttgtagcagctcctggtttggcgctgtgcacatcccttcctctgcccctgttgaagtgggagtgggcctgctgccctcctggagcctcaggagaacatagcagaaagcccagccgggtatcacccaagcagaagctcgtctgggctccagaattcttcgtgggttatgtgcttatggcttcacaactgccacgtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagc

SEQ ID NO: 165447 - DNA, 2722 bp, Homo sapiens
  Payload ID: 12569
  Gene Symbol: PDE8A
  Gene Name: phosphodiesterase 8A
  Uniprot ID: O60658
  ENST ID: ENST00000478717
  CDS Start-End: 183-869
cgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagc

SEQ ID NO: 165448 - DNA, 2584 bp, Homo sapiens
  Payload ID: 12569
  Gene Symbol: PDE8A
  Gene Name: phosphodiesterase 8A
  ENST ID: ENST00000559742
  CDS Start-End: 183-878
cgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagc

SEQ ID NO: 165449 - DNA, 3716 bp, Homo sapiens
  Payload ID: 12569
  Gene Symbol: PDE8A
  Gene Name: phosphodiesterase 8A
  Uniprot ID: O60658
  ENST ID: ENST00000557957
  CDS Start-End: 204-2477
tcggagaggacaggaaggagccggctgcaccgcgccagggtctccgcaaaccgggagcccagggagggcgggaagactggcgggggtccgaggcagcccgctacaggatacgtgatggacgcccagagacaccgccctccagctggtgggggaggagccccagccaccaagaagtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 165450 - DNA, 538 bp, Homo sapiens
  Payload ID: 12569
  Gene Symbol: PDE8A
  Gene Name: phosphodiesterase 8A
  ENST ID: ENST00000559086
  CDS Start-End: 1-381
gcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcagaggtatgtagaaaaccccaacatcatggcctgctacaatgaactgctccagctggagtttggagaggtgcgatcacaactgaaactcagataatcagacaggcaaacataaagacaggagaaaaggctcactagacgtcaaagctgttgcctcccgtgcaactgaag

SEQ ID NO: 165451 - DNA, 5956 bp, Homo sapiens
  Payload ID: 12570
  Gene Symbol: PDE8B
  Gene Name: phosphodiesterase 8B
  Uniprot ID: O95263
  ENST ID: ENST00000264917
  CDS Start-End: 46-2703
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggagggccgtattaggaaaatgcaacactctctaataatttccgtgactagtaagagaaggaagccagttataaaacactgctggaccagaatgaccctataatttcctaagatcattctttatttctaatttaagatttttaaatttacttgccctccatgtcaggactggttagcattctgggcaaaaaaaaaacaagcctgtcagttcactcagaacctactcagctttagagagagaaacagaagggatgatcttgtgcccttgcgctatgtgaatatagccagagactgaggtaataaatatattttaaaataaaaatgacaagggatttgtacactgtaacactatgtagtgttacttctgctgttgcaagtatcttaactgttgaaagctaaactcaggaaatggagaaaatgtacataatatacattgacccattattttattctaaattgaaagtccaacttttagcagcagtctacctgcaactactgaacaccatcaggtttgagtccctaccagaatctcccatcatactgttatcccccatctctgtgaccttagggcatgcatgaaaacaaaagcaatctagtccctagggttggagactgccctctagacagtttttcatggcagaaaattagaatacaagtatacctcattttattgcattctgcttcattgtgcttcaaagatactgccttttctacaaattgagggcttgtggccaccctgcatagagcaagtctatcggggcattttcccagcatgggctcactttgtgtaagtgtcacattttggtaactcttagagtatttcaaatgtttttattcttgtatctgtcatggtggtctgtgatcagtgatctttgttactactgtaattgttttagggtactgcaaaccatgcccgtataagacagtgaacttaattgataaatcttgtgtatattctaactgttccaccaactagcggtttccagtctctccctcttcttagacctccctattccctgagacacaacaatatcga

SEQ ID NO: 165452 - DNA, 3276 bp, Homo sapiens
  Payload ID: 12570
  Gene Symbol: PDE8B
  Gene Name: phosphodiesterase 8B
  Uniprot ID: O95263
  ENST ID: ENST00000346042
  CDS Start-End: 46-2412
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaa

SEQ ID NO: 165453 - DNA, 2572 bp, Homo sapiens
  Payload ID: 12570
  Gene Symbol: PDE8B
  Gene Name: phosphodiesterase 8B
  Uniprot ID: O95263
  ENST ID: ENST00000333194
  CDS Start-End: 1-2493
atgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttc

SEQ ID NO: 165454 - DNA, 3426 bp, Homo sapiens
  Payload ID: 12570
  Gene Symbol: PDE8B
  Gene Name: phosphodiesterase 8B
  Uniprot ID: O95263
  ENST ID: ENST00000340978
  CDS Start-End: 46-2562
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaa

SEQ ID NO: 165455 - DNA, 2677 bp, Homo sapiens
  Payload ID: 12570
  Gene Symbol: PDE8B
  Gene Name: phosphodiesterase 8B
  Uniprot ID: O95263
  ENST ID: ENST00000342343
  CDS Start-End: 1-2598
atgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttc

SEQ ID NO: 165456 - DNA, 574 bp, Homo sapiens
  Payload ID: 12570
  Gene Symbol: PDE8B
  Gene Name: phosphodiesterase 8B
  ENST ID: ENST00000503963
  CDS Start-End: 218-574
gacaaactcagaacttcgatgcagaagcagtgtgcaggtcgatccgggccacaaatccctccgagcacacggtgatcctcgcagtggtttcgcgagttgtgaggaatcctggtttgtatctgctgagtgaccacattttctgctttgctgcagatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacag
